United States Patent 7,745,391 (HUMAN THROMBOSPONDIN POLYPEPTIDE) - sequence listing, part 165

SEQ ID NO: 422989 - DNA, 1976 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcatacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422990 - DNA, 962 bp, Homo sapiens
  misc_feature (11)..(11): n is a, c, g, or t
  misc_feature (15)..(15): n is a, c, g, or t
ctagaactcgnggancccctgtgctgcaggaattcggcacgagcgggaacctttttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422991 - DNA, 960 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422992 - DNA, 841 bp, Homo sapiens
  misc_feature (14)..(14): n is a, c, g, or t
ccagaggatcccanctctcctctcgacatctctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422993 - DNA, 1434 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggtcggagagggaggggatgtcggagagggagaggatgtctgagagggagggatgtcggagagggaga

SEQ ID NO: 422994 - DNA, 1409 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422995 - DNA, 140 bp, Homo sapiens
cttacaatactggtagtcagtattaggttgacagctggtcctgagaacttctttccttctcattgtagattttcataaacaatgaatggcacgatgccgtcagcaggaaaacattccccaccgtcaatccgtccactgga

SEQ ID NO: 422996 - DNA, 950 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggagctgcttcccctgtgtgtccactgtgctgattgcccccggctgggcgcgttgcctccctgagatttgccagtggcttcccggccccggattgcccgttaccaggtttgtggaaccgacccaatggccttgctgggggaaagccccattctttagccctgttggccgtgccgcccttccgttcaccggctttgtcgcgcc

SEQ ID NO: 422997 - DNA, 242 bp, Homo sapiens
  misc_feature (14)..(14): n is a, c, g, or t
ccagaggatcccanctctcctctcgacatctctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggtcggagagggaggggatgtcggagagggagaggatgtctgagagggagggatgtcggagagggaga

SEQ ID NO: 422998 - DNA, 1953 bp, Homo sapiens
cacctcatggacctggcaggaaacaaggctgcagccttggatatagccatgattaaaatggtcgccccgtccatggcctcccgagtgattgatcgtgcgattcagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422999 - DNA, 1970 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaagaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 423000 - DNA, 1975 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccgtatgccggctgggctgataagtaccacgggggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 423001 - DNA, 2038 bp, Homo sapiens
  misc_feature (2024)..(2024): n is a, c, g, or t
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattggtatgtaatctagcgacgtgtgtgttaaggtgagggatacgatgactcgcactaacggggcgactagcagatggcacantgggacagttggga

SEQ ID NO: 423002 - DNA, 4661 bp, Homo sapiens
gcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaaggagcctcctccctctggccttaattctgcctcctgggggcttcccagtcaaatccagtccttctctcaagaggatttgaggatggccaccgtgtccctccttgttgcgaggaggttctcatggccagaggtgtgatgccgccaggcttcgggctcaccccacgagcctggtatggttatcactcagccagatgaagcttctggtctgcttccagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423003 - DNA, 3727 bp, Homo sapiens
  misc_feature (19)..(19): n is a, c, g, or t
  misc_feature (36)..(36): n is a, c, g, or t
  misc_feature (40)..(40): n is a, c, g, or t
ctatagtatccccgagtantgtacgaggcgggtggngcanaagagcactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423004 - DNA, 2418 bp, Homo sapiens
ccgagctcggttccccagttacaacagcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423005 - DNA, 4601 bp, Homo sapiens
  misc_feature (4454)..(4455): n is a, c, g, or t
gcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaaaaaatannttaaaataaaaaaataataatattaaaaaaaatttaagtggggtcctggtacccaaatttccctttggtgagtcgttttacaattaaaatgtcccggggggtgccatgggccctaaatttggcaaaaactttggccgtttccccaa

SEQ ID NO: 423006 - DNA, 3415 bp, Homo sapiens
gcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaaga

SEQ ID NO: 423007 - DNA, 1502 bp, Homo sapiens
atggcatcctaattcttgtcccccccgatatccctcactttctcctaccccgccagtagatgtacccgagccctcatccggactatcctgtctcccctattttaccagtaccattatcacccaccaattaattttcttttttttttttgacacggagtcttgctctcacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423008 - DNA, 518 bp, Homo sapiens
cagtgagctgagattgtgccattgcactccacactccagcctgggcaacagagcgagactccatctcaaaaaaaaaaaataaaaacaaaacaaaacaaaaaagagacacatcaggtgggctcagtggctcacccctataatcctagcactttgggaggctgaggcaggtggattgcttgaatctaagagttcaacaccagcagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423009 - DNA, 242 bp, Homo sapiens
gtctctcaaaacactgggattacaggcatgagtcactgtgactgcctccacccccgaccatttaataggggaggaaatgggacagtcctgagggtggggattgtcccttggcatctgggggtgggatggtgtgtttctactgcccagagcctgggagctccccagtagcatggaggtctggtgatgggcctggcgtttgtcttacaggccaacaccaacacggacctgaggctggcagctgc

SEQ ID NO: 423010 - DNA, 4447 bp, Homo sapiens
gcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 423011 - DNA, 3949 bp, Homo sapiens
gcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttggtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaaaaaaaaaaaaaaaaaaaaaaaaaaaaaaaaaaaaaaaaaaaaaaaaaaaaggggggggcccccaaaaattccccccggggggccccaatcgccccccccgtttttgggacaaagggggccccccatatagagggcgcgcaggaatataaacgcgacggagcaccggggcaacgagaataacaacagccggagagggggaaaacgagcgcgccacagtgaggaacactacgtaggaggaggcgagccccaataccacgcggggggggggaggaaccaaaatggggagcaacaaacacccccccgacagcgagagatgatacaagcgccccagggcgggaaaaaactacaacaaccatgctcgaggggtactgctcgaggggtataacaaccacagcgcaacatttcgcctgcgggcagagcaagaaagatgggcgacaacaggcagacgcgcgactgtgcgacaacacactttactccccgagggcactataagtaagaaacgcg

SEQ ID NO: 423012 - DNA, 2742 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423013 - DNA, 737 bp, Homo sapiens
  misc_feature (76)..(77): n is a, c, g, or t
  misc_feature (84)..(84): n is a, c, g, or t
  misc_feature (97)..(97): n is a, c, g, or t
  misc_feature (104)..(105): n is a, c, g, or t
catctcaaggtattcggggcccaccaaaaataatcccccccgcatgtcaggaatagagtgtctagctgttcttgannccacacnaaaagatatgccntgctaanntaagcagtcctgccgtcatcactgacaaagtaatcccagcttgtctgccatccccaaattatgtggtcggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423014 - DNA, 3520 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgtatggggagtcatgcaaaccgattctgttattgggaatgaaatctgtcaccgactgcttgacttgagcccaggggacacagagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtgacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaagagctgtgtttatttcattgacaaatagattatttgtattc

SEQ ID NO: 423015 - DNA, 2684 bp, Homo sapiens
  misc_feature (767)..(767): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagctatgacggcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423016 - DNA, 3466 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgtatggggagtcatgcaaaccgattctgttattgggaatgaaatctgtcaccgactgcttgacttgagcccaggggacacagagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtgacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaagagctgtgtttatttcattgacaaatagattatttgtattc

SEQ ID NO: 423017 - DNA, 2688 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423018 - DNA, 2698 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgcgcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423019 - DNA, 2689 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423020 - DNA, 1519 bp, Homo sapiens
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaac

SEQ ID NO: 423021 - DNA, 2083 bp, Homo sapiens
  misc_feature (825)..(825): n is a, c, g, or t
  misc_feature (1941)..(1941): n is a, c, g, or t
  misc_feature (2078)..(2079): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtcccaggcntcatctacaggtcatctgggtgccacatgttgtaagagcagcgcgccacgaagaccatgtgcacaattgcgacgcagtacggtggaacagctgggctgaccccagtatatatttgtcctgttggggaggaccgcttnncgct

SEQ ID NO: 423022 - DNA, 2393 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaaggtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctga

SEQ ID NO: 423023 - DNA, 2174 bp, Homo sapiens
  misc_feature (825)..(825): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcaggactgctggattctgtagtaaggtgacatagctatgacatttgttaaaaataaactctgtacttaactttgatttgagtaaattttggttttggtcttcaac

SEQ ID NO: 423024 - DNA, 2028 bp, Homo sapiens
  misc_feature (825)..(825): n is a, c, g, or t
  misc_feature (1880)..(1880): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacagtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtcccaggcntcatctacaggtcatctgggtgccacaggagtgatctcgacgctgtcggaatgaatgttggcgtctggagcccgaagtgctgttactagagctgcgctctggaccagtgtggtccattggctacggcggttccgggggacgttgctgc

SEQ ID NO: 423025 - DNA, 1912 bp, Homo sapiens
  misc_feature (825)..(825): n is a, c, g, or t
  misc_feature (1809)..(1809): n is a, c, g, or t
  misc_feature (1857)..(1857): n is a, c, g, or t
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgngacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaataatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggttngatgactctgtgagcacctgatatccgagtggtgtgctgtgcactgtngagagtccaaagctatctcaagcatctggtgcacagagtgattgaccgtgtagaa

SEQ ID NO: 423026 - DNA, 1086 bp, Homo sapiens
gtatttttagtagagacgaggtttcactgtgttagccaggatggtctcaatttcctgaccttgggatccacccacctcagtctcccaaagtgcggggattacagacgtgagccaccgtgcccggccgcactacaggtatttaaccaggagctgaactccttgactccactccttgattttttaggacctaagtgtgaaacaggctacctcatcatggaccccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggcatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccatcgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtagtaatcaaaacttaagaacaaa

SEQ ID NO: 423027 - DNA, 1825 bp, Homo sapiens
atttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtaggcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtgggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatcaggattctcccatgcccccctttattttgccatagac

SEQ ID NO: 423028 - DNA, 1786 bp, Homo sapiens
atttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtaggcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtgggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccacca

SEQ ID NO: 423029 - DNA, 2223 bp, Homo sapiens
  misc_feature (783)..(783): n is a, c, g, or t
tagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatncaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtgggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatcaggattctcccatgcccccctttattttgccatagac

SEQ ID NO: 423030 - DNA, 1089 bp, Homo sapiens
tagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggcccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggcatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccatcgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtagtaatcaaaacttaagaacaaa

SEQ ID NO: 423031 - DNA, 805 bp, Homo sapiens
tagttctgcgcgttcacgtccccgatcgggccgtgtccgccgcggccctgcgaggtccgagggactcattctgatgaaggaaagagcgtccctgtgcagctgcgtgtccttcagttctttggctctgattccgtgtctggcttcatctaagtggcctggtccatgggcagtgaagaaatgtaaagtgcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacaggtgggttatcggtttatcctctgtttcatgaaaatgatccagtcacaggtgggttatcggtttatcctctgtttcatgaaaatgatccagtcacaggtgggttatcggtttatcctctgtttcatgaaaatgatccagtcacaggtgggttatcggtttatcctctgtttcatgaaaatgatccagtcacaggtgggttatcggtttatcctctgtttcgtgggtgttatgaggcttacagaaatctctgcaacacacagaagggtctaaatacatttaaataagagaaaatataaacttgggaaagaagatgtccaaagaagcacaaagtagattatagaaacatacaaaagtctcagctgggcatggtggctcatgcctgtaatcccagccctttgggaggccgaggagggcagatcatttgaggtcaggagtttgagac

SEQ ID NO: 423032 - DNA, 1142 bp, Homo sapiens
tagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacaggacctaagtgtgaaacaggctacctcatcatggaccccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggcatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccatcgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtagtaatcaaaacttaagaacaaa

SEQ ID NO: 423033 - DNA, 2714 bp, Homo sapiens
cggacttagaaagctagaagaccctgatgatagcagccctggaaaaatattttctaccctgaagagaccgcaagtggaaacgaaagacagaattgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctctttttttttctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattgaaaaaaag

SEQ ID NO: 423034 - DNA, 1896 bp, Homo sapiens
gtttttccttcagtttcctatatgagttatttaaggatttagatggttttatgagccacttagtatttacaacccttcttaattgtaccctcttcctcacaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctctttttttttctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattgaaaaaaag

SEQ ID NO: 423035 - DNA, 2653 bp, Homo sapiens
cggacttagaaagctagaagaccctgatgatagcagccctggaaaaatattttctaccctgaagagaccgcaagtggaaacgaaagacagaattgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctctttttttttctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattgaaaaaaag

SEQ ID NO: 423036 - DNA, 448 bp, Homo sapiens
catcaacaagaatgatgtgccaggaacctacaaagagttacaaaacagggagaagggagttcatttgtatttgggtggagaggggaatgtggaggtagctctgagctggtcgttgaagatgagcaggattttgaagagctggggaaaaggacattcctggaggcagaaaggcagcatgtgctagaccagagggacaggaaacacccatctttttaactctcctggtcaccaatgtcttgtgtttcagaagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgac

SEQ ID NO: 423037 - DNA, 1575 bp, Homo sapiens
aaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagcattgacttcatactgcttttaagtggagaaatgctgaaggctggtatgaatataaaagtgattaaaaggaaatagattatgcagaagtagaaaaattcattggattcatcattgtaattggtgtttataaatctaaaattgaaaatgttttgcagtcatggaccaaagaagataactgttctcttttcaacacaattgggagccatcagtggttttagaagtgttgcaatttgacagaacaaatgcaagaaagaagaactagattaataagctagcgcctgttagaaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcatt

SEQ ID NO: 423038 - DNA, 107 bp, Homo sapiens
aaaaaaaaaaaaaaaagaaaagaaaaaagaaaaaaaaggattccatttgaactaggaacattctctttgagtagcccaaaggagaaaaggaagtattaatgataata

SEQ ID NO: 423039 - DNA, 1915 bp, Homo sapiens
  misc_feature (667)..(667): n is a, c, g, or t
  misc_feature (860)..(860): n is a, c, g, or t
agcttttctggaaaacatctaatgtataaaacagtatattttttatctcacaattaaacttttcctgtacatcatttgattttatggctttaaaaaaatcattaaaggtgccaagtaatgattagagaaatgagttgttggggtcatattgttggcggaagaggagctgggatgaaggcgtgttccgggcctgctgaagttgtcacatagcatctcgcccacagttggatcgatcaacccgggaggtggagctgggcttggaatacggatccccgactatgaacctggcagggcaaagcctgaagtttgaaaatggccagtggatagcaggtgagctgcacttcctgccattttgtcaaacaagattgtaggaggaaatccccctttaactggttctgtccttcctccagagacaggggttagtggcggtgtggaccggagggaggttcagcgccttcgcaggcggaaccagcagttggaggaagagaacaatctcttgcggctgaaagtggacatcttattagacatggtgaggcaggtgatggggaagagaggcctagcttctccttttggggaggctccacctcgagtcacttaatccaacagatatctcctcaatgccagtttggccaggtacgttgctttgcatccaaagccacacgcaagnaacaagacacagttcctgccctcacagtgtagaggcaggtggaccgaccgtaagcataattacataaggacccagttggagtctgcacaggatctgcacagcacacgagggagaagttatttctgtcaagtcgggagagcttcccagaggaagggatatctgagctgaatgtggaaggataatggcaggaatngaggttagatgaaggcattccaggaagaggggtagagccggctcatggcttggaagtgtctcataccaagtaggcattaatcagtgcccagtacagaccagctgaggggctcacactgcattagtgttggtttcttgtggctgttaaaaatccagcaacccactgggcctagaggagcctgtgaaggttcagaggcaggagagcatacactgtagtggttaagagcacacactccagagcaaaatggcctgggttcctcacccagctctgctactgactaactgctctgtaacttaatttcttcagcaataaatggcataatagctaattgtggtggtgcacccctgtagtcccagctacttgggaggctaagacaggaggatggcttaacctcaggagtttgagagcagccttggctgcaaagtaagatgccatctttttttttttttttaaaaaggactaggctgggcatgatggctcatgcctgtaatcttagcattttgggatcacaggcatgagccaccacgcccggcctggatgtttttttttaaaaatgagcataatcgtagtatctacctcatagtgagttagtacaagaaaagcacccagcctggccgacagagcgagaccgtgtctcagaaaacaaacaaaccaaaaaacaaaaacaaaaaaaccctaaggaggaaagtggcattctatttccagcattttttcccctcatccccattatgggagctacagcttagaatcaatttcagctctaatcccttagccttacaatcaccagtatctgcctttgacgtcctctgagacctgctctccttcgtgcagggagtgccatgccctcgtgggtgacagcgtgctgacagagtggactgtgaatattcttcaagtacttgtggtcctgggtcatcaggggttgcattctacccagttacagagggtttcccatcgaggaggccagcagcatcagagaagtggcagggggcctttcctccgtgtgtagggccggccttgctaacccgaaacatttcctagaaatgtgctgcttgcta

SEQ ID NO: 423040 - DNA, 1162 bp, Homo sapiens
atgcgggtggcgggcaggcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423041 - DNA, 1302 bp, Homo sapiens
atgcgggtggcgggcaggcggcaggaggcgggtgggtcaaggtaactctgggctacagagtccttgctgggggttcggggagcgcttggaccccggcttctgggacgcgtcagaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423042 - DNA, 1046 bp, Homo sapiens
atgcgggtggcgggcaggcggcaggaggcgggtgggtcaaggtaactctgggctacagagtccttgctgggggttcggggagcgcttggaccccggcttctgggacgcgtcagttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423043 - DNA, 1287 bp, Homo sapiens
caaaccatagcaccaggatcgttagtagccacatgataaaatgtatgtcttcaagatttgaagacaatggcataaggtcagtgatccagctgcttgtacccctgactttttctgaccctaggagaagggagcactggctttgctttcatcaggccaaagatgcctttctttgggaatacgttcagtccgaagaagacacctcctcggaagtcggcatctctctccaacctgcattctgtgccaagtaatgattagagaaatgagttgttggggtcatattgttggcggaagaggagctgggatgaaggcgtgttccgggcctgctgaagttgtcacatagcatctcgcccacagttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423044 - DNA, 1168 bp, Homo sapiens
caaaccatagcaccaggatcgttagtagccacatgataaaatgtatgtcttcaagatttgaagacaatggcataaggtcagtgatccagctgcttgtacccctgactttttctgaccctaggagaagggagcactggctttgctttcatcaggccaaagatgcctttctttgggaatacgttcagtccgaagaagacacctcctcggaagtcggcatctctctccaacctgcattctgtgccaagtaatgattagagaaatgagttgttggggtcatattgttggcggaagaggagctgggatgaaggcgtgttccgggcctgctgaagttgtcacatagcatctcgcccacagttggatcgatcaacccgggaggtggagctgggcttggaatacggatccccgactatgaacctggcagggcaaagcctgaagtttgaaaatggccagtggatagcagctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423045 - DNA, 2054 bp, Homo sapiens
  misc_feature (717)..(717): n is a, c, g, or t
  misc_feature (910)..(910): n is a, c, g, or t
caaaccatagcaccaggatcgttagtagccacatgataaaatgtatgtcttcaagatttgaagacaatggcataaggtcagtgatccagctgcttgtacccctgactttttctgaccctaggagaagggagcactggctttgctttcatcaggccaaagatgcctttctttgggaatacgttcagtccgaagaagacacctcctcggaagtcggcatctctctccaacctgcattctgtgccaagtaatgattagagaaatgagttgttggggtcatattgttggcggaagaggagctgggatgaaggcgtgttccgggcctgctgaagttgtcacatagcatctcgcccacagttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatggtgaggcaggtgatggggaagagaggcctagcttctccttttggggaggctccacctcgagtcacttaatccaacagatatctcctcaatgccagtttggccaggtacgttgctttgcatccaaagccacacgcaagnaacaagacacagttcctgccctcacagtgtagaggcaggtggaccgaccgtaagcataattacataaggacccagttggagtctgcacaggatctgcacagcacacgagggagaagttatttctgtcaagtcgggagagcttcccagaggaagggatatctgagctgaatgtggaaggataatggcaggaatngaggttagatgaaggcattccaggaagaggggtagagccggctcatggcttggaagtgtctcataccaagtaggcattaatcagtgcccagtacagaccagctgaggggctcacactgcattagtgttggtttcttgtggctgttaaaaatccagcaacccactgggcctagaggagcctgtgaaggttcagaggcaggagagcatacactgtagtggttaagagcacacactccagagcaaaatggcctgggttcctcacccagctctgctactgactaactgctctgtaacttaatttcttcagcaataaatggcataatagctaattgtggtggtgcacccctgtagtcccagctacttgggaggctaagacaggaggatggcttaacctcaggagtttgagagcagccttggctgcaaagtaagatgccatctttttttttttttttaaaaaggactaggctgggcatgatggctcatgcctgtaatcttagcattttgggaggccaaggtggacgggtcacaaggtcaggagttcgagaccagcctgacctcaagtgatctccctgtcttggcctcccaaagtgctgagatcacaggcatgagccaccacgcccggcctggatgtttttttttaaaaatgagcataatcgtagtatctacctcatagtgagttagtacaagaaaagcacccagcctggccgacagagcgagaccgtgtctcagaaaacaaacaaaccaaaaaacaaaaacaaaaaaaccctaaggaggaaagtggcattctatttccagcattttttcccctcatccccattatgggagctacagcttagaatcaatttcagctctaatcccttagccttacaatcaccagtatctgcctttgacgtcctctgagacctgctctccttcgtgcagggagtgccatgccctcgtgggtgacagcgtgctgacagagtggactgtgaatattcttcaagtacttgtggtcctgggtcatcaggggttgcattctacccagttacagagggtttcccatcgaggaggccagcagcatcagagaagtggcagggggcctttcctccgtgtgtagggccggccttgctaacccgaaacatttcctagaaatgtgctgcttgcta

SEQ ID NO: 423046 - DNA, 193 bp, Homo sapiens
atgcgggtggcgggcaggcggcaggaggcgggtgggtcaaggtaactctgggctacagagtccttgctgggggttcggggagcgcttggaccccggcttctgggacgcgtcaggtcgccgtgaagatgattgcatgagatcgtgcgtgtgaacgtttgttgacagctgttacttgagtccgacagccctgggg

SEQ ID NO: 423047 - DNA, 1243 bp, Homo sapiens
ctttgagaatccgatgaaaaccagagattccgcccttgttttcttagaattaaaaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423048 - DNA, 1279 bp, Homo sapiens
atgcgggtggcgggcaggcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctgtgccaagtaatgattagagaaatgagttgttggggtcatattgttggcggaagaggagctgggatgaaggcgtgttccgggcctgctgaagttgtcacatagcatctcgcccacagttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423049 - DNA, 1108 bp, Homo sapiens
atgcgggtggcgggcaggcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatcaaactgtgaccaaa

SEQ ID NO: 423050 - DNA, 1382 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423051 - DNA, 1279 bp, Homo sapiens
  misc_feature (9)..(9): n is a, c, g, or t
cgtacccgngcccgtaattcccgggtaacagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423052 - DNA, 374 bp, Homo sapiens
ggcctagagcctggactcattcattcaacaaacaaacgttgagtgaccgtttagtactagtcccaaaggtagatgcagacaacgtccttgctcttgagggtttacactacgggagatacaacaaagaagtaaacagacagtgtcatttcaagtaatgagaagtgttactaacaaaacagactgtgattgaggggacttggaaaagtgttgtggtggtgaagcaacttataaactgagatctgaaaaaacaagatgcagccagctatgtgaaaattggcgtgcagagcaattgagaaactggattagcaagtgcaaaggtcctgtggtgggaataagcttggcatgttcaaggaccagaagggggccagtgtagc

SEQ ID NO: 423053 - DNA, 1669 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaaaaaaaaaaaaaaaaaaaacaaaaaaaacaaaaaaaaaacaaacaacaaacaacaccgcgagaggcattcttattagcgcggaggggcgcgacacaaacacgagggtatacagagaagagggcgccaacggggcgaccaaaaagggcggttccccagaggaaaccacaggtttgctgtggtccaaacagggggtgcaacctactaagggggaggtcccccccatatagaggagaggcggaataacaatccggaagaaaccccgggtgataaccccggcgataaagggg

SEQ ID NO: 423054 - DNA, 2406 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaaaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatgg

SEQ ID NO: 423055 - DNA, 1249 bp, Homo sapiens
aaactgcgggtctctgcaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423056 - DNA, 1332 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctggtcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423057 - DNA, 1231 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctaccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423058 - DNA, 1136 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctaaaaacatgctccacaaattcaacttgtatatttggcagattaaacttgacattatcgtaa

SEQ ID NO: 423059 - DNA, 1004 bp, Homo sapiens
tgtagtcaaagggatattgaggccaatgctaagtcagcaaactccattaaactaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423060 - DNA, 1165 bp, Homo sapiens
atcctcccagtactgacactgaaaacttgtgatcagaagaacaccaacaagtgctccctgggctgaggaccctttcttgcctccccaccccggaaggctgaacctgagggagacaacgtgcagagggagtgagcaggggagaaatagcagaggggcttgagggtcacataggtagatggtaaagagaatgaggagaaaaaggagaaaagggaaaagcagaaaggaaaaaaaaggaagagagaggaagggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423061 - DNA, 966 bp, Homo sapiens
ctctagcaggatccctgcatatctgggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423062 - DNA, 2186 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagcccccaaaaaggagaagaaatctctagactcagatgagagtgaggatgaagaagatgactaccagcaaaagcgcaaaggcgttgaagggctcatcgacatcgagaaccccaaccgggtggcacagacaccaaaaatcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaaaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatgg

SEQ ID NO: 423063 - DNA, 673 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatgggatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423064 - DNA, 453 bp, Homo sapiens
taacgagcatcagtaagcggagcggtcacgcctgctgggggtatgttgtgtcgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaa

SEQ ID NO: 423065 - DNA, 489 bp, Homo sapiens
gtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagaaaggaaagaaggaaggaaagaaggaagaagagagagaaggaaggaaaagaaggaaggaaggaaagaaagaaagaaagaaagagagagagagaaagaaagaaagaaagagagagagagagagaaagaaagaaagaaagaaagaaagaaagaaagaaggaagg

SEQ ID NO: 423066 - DNA, 430 bp, Homo sapiens
ttcctggactatgggaatggcctctaagctgtggtgctaagtgcataggctgcctgtgtctggcccaggtcccattccctgggggccagggtcacagtaggacccttgtcatccttggttccagccttccagaggcttgatttctcaagatccacagtctggggggtgatagggtcacagtcttggggatttgttttgcatttttgattctgcaggttgtccatttctgaaacaggaagaagaggagcaaaaagaaggtggagatggggctgcaggtgaccccaaaaaggagaagaaatctctagactcagatgagagtgaggatgaagaagatgactaccaggtactgagttcttttgagggcctagagcctggactcattcattcaacaaacaaacgttgagtgaccgtttagtactagtcccaaagg

SEQ ID NO: 423067 - DNA, 3893 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423068 - DNA, 517 bp, Homo sapiens
  misc_feature (435)..(435): n is a, c, g, or t
  misc_feature (460)..(460): n is a, c, g, or t
ggactatagtagtaacctgcactttatcttagcaagcctttatgagtctattagctttacctcaaaattttaagccagaactatcatctttgtttttttattttctatctttaaacatttatctgtgaagtgacaaatggcctacagctgtgagagcaaatggacatctcctcctgaactctgagaaggtaaggcttattgcatcttaaaagtttaaaattctgtggaaggcttttcagatttaggttgttgcacttttttttaaatgtatgtaagaaataatgtgtcctcaggtgatccacctgccttggcctcccaaagtgctgggattataggcgtgagccaccatgcctggcccatttggtcttttatctacaattttatttttattaattattcaagaataatttaagagcttcctaaataagtagcttngtaaatgttatagcccccttcttanaaatgtggattctatagatgaaatgtctctcaggttcctcatgcgttacatattacg

SEQ ID NO: 423069 - DNA, 642 bp, Homo sapiens
gcgtattgtctgattggtgttgatcattttgttgatgatcttgttgaccatgtgcgtgaattacagatgcaacatgcattgttagaatcgtgtgatggtcttttgtgatactgaatttgtacatatcccagtctctgtatgtatctgcatagacaaagggatacaccggtgtttccctttgtctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacttgttatacttgag

SEQ ID NO: 423070 - DNA, 361 bp, Homo sapiens
ggactatagtagtaacctgcactttatcttagcaagcctttatgagtctattagctttacctcaaaattttaagccagaactatcatctttgtttttttattttctatctttaaacatttatctgtgaagtgacaaatggcctacagctgtgagagcaaatggacatctcctcctgaactctgagaaggtaaggcttattgcatcttaaaagtttaaaattctgtggaaggcttttcagatttaggttgttgcacttttttttaaatgtatgtaagaaataatgtgtcctcaagtgatccacccgcctcagcctcccaaagtgctgggattacaggcgtgagccaccatgcctggccatat

SEQ ID NO: 423071 - DNA, 4765 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtattttttttaaaaaaagaaaagtagtaaattagcagctttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctga

SEQ ID NO: 423072 - DNA, 3819 bp, Homo sapiens
ggctgtagttagtaaggagccggatgattgcctcagcaggtgtgaagcgtgtgctttagtttcgtgggaggcctggcatccccgagagggaggggaaaggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423073 - DNA, 3810 bp, Homo sapiens
acgaagtattagagcgcccgatgatcatgctgcgcttattactcttgcctggcgcgttaacgtgattgcacagtcggtgcggtgcatggggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423074 - DNA, 3755 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423075 - DNA, 5621 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtattttttttaaaaaaagaaaagtagtaaattagcagctttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgactattacagatttattcttttattcttgttggagtgtcttttaatatctgcgccatctgtcttcatatgaggaaaaaatgtaaggcattgactaacaggagaaacatttctaattttgatgggtttaatatggagaaagaacaattttgataacccagaggaacctgaattctaactgcggttatgtaaatagagtttattgagcttccttattttgctctccgcagttagggaccactaggcctagtcatatggtttatcacagatttattgaagccaatcataggatgttagaattagaaatcatcaagtgcaaataatcacttatctactagggacaggcactatagcatagtggggtaagagcgcatgctctgaaatcagactagctaggttagatttccagttcttctttttgctactaggatgctcttggccaattactcggagctgcagttcttcatctataaaatggaactaatactggtaccttgtaggcttattgtgagacgtttaggtgaactgatctaggaaaatcataacacagtgcctggcaagtagtaagtctttagtgaatgttaccattgaagaagaagaagatgatggataccaaggtatattggcttcagattactgtagtctgtaatcatgtcctttgtgttggttcctttggggcaactgattctttctttgcactcctctagattcttttgctgtcctctctgatctgcaaagccttaattatttctgaaattaagtaatactttctgttgcctaaacacaaacctacttgtgtttaacttaggaaaattaaactatgtgtgcttggccagaaaaaaaaaaagagagagaaagg

SEQ ID NO: 423076 - DNA, 4726 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtattttttttaaaaaaagaaaagtagtaaattagcagctttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctga

SEQ ID NO: 423077 - DNA, 3160 bp, Homo sapiens
atgtctatactccaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423078 - DNA, 2808 bp, Homo sapiens
  misc_feature (188)..(188): n is a, c, g, or t
  misc_feature (211)..(211): n is a, c, g, or t
tcagtcttgtcagttgacacccactgtatttctccacttgtttcttgccactctccactcttatcatgctgagtggtgggagcatctttgatcaactcatctgttttactttctgctagctgggctgcccgctctcgctcaaggaatagctgcactaaagcctggacagcatgaacttgtccacctanccttaaactatcatccccttctncactacagatggaagaatcaaaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423079 - DNA, 3633 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcaagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423080 - DNA, 3859 bp, Homo sapiens
  misc_feature (3806)..(3806): n is a, c, g, or t
  misc_feature (3828)..(3828): n is a, c, g, or t
  misc_feature (3832)..(3832): n is a, c, g, or t
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagaaaaaaaaaaaaaaaaaaactcgaggggggggcccggtaccccaaattcgcccctattagtgagagtcggttttaccatttccaacctgcncccgtcggtttttacaaaccgntcgnggaacttggggaaaaacccctgtgcgg

SEQ ID NO: 423081 - DNA, 3486 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggaga

SEQ ID NO: 423082 - DNA, 845 bp, Homo sapiens
tggcatactgcctagttcactagcaatgactttgttgtcaggcagttttccgttattggcctcaaagtgtttacgtagaacagacagggtggtatgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423083 - DNA, 2349 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaaggtgaatgataaaataggtgtggactagatttattgattgtcaataggggtgtcttgtggcttcaaatatctaataaattattgtggagggga

SEQ ID NO: 423084 - DNA, 2135 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctgtatgtgataggctatgctctgaaggctgttttagaagagctgttaatagacttgacagtgttattagcagtgagttctacagtagaacctggagctataataaaaatatcatacagttttgcggcagaaaatagacctatttagcaattcatttaacttgaacatcccatctataatgttgataaaggtagtgttttaaagtcgatgtgtgcatagcatgtgtagagaactttgatgatatttctggcagtggccattttagatactggtagttacaatcctttctttctgtggtgtttctgtcgtcctcctctcatccctccgtttctgttataactctcttctatttagctgagttaaccctttacatttttatttttgacaactttgtatacccataatactatgagagacaatggtctgttaggcttgttgaaataaaaaagcagcaatttcctcatcac

SEQ ID NO: 423085 - DNA, 1557 bp, Homo sapiens
tgttgtttgtatatggtccaaaaaatgcctaaccagaggatgggtcaataaagtcagcccaataaccctcagctcgaagagcatagcaaatttccttagcaccattgatgaacttttctaagagcacttctctttcaatttctacttcttcactccaaacagtcatatcattcttagtttttttgtgttacagtcagaatcattagtttgccattagctacttctggaaacagtgattcaaaatcttttcgcagcaattctggacatgtttgtattgcacactcacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtattttttttaaaaaaagaaaagtagtaaattagcagctttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctga

SEQ ID NO: 423086 - DNA, 1360 bp, Homo sapiens
ctgttccgtccgtatcactcaggcattctcacaagatagcaagagatctgtgatccatacaggcgtaatgaatgatcgaggataaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtattttttttaaaaaaagaaaagtagtaaattagcagctttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctga

SEQ ID NO: 423087 - DNA, 771 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaaggtttgatagtggttgatatttatgttggttgaagttttatatttttctgatttatatgtgcattcccagtactagcacagtgcccaacacataaaatgtactagatcatttttttaaagtatcaaagcaaaaaattatctttctggccaggcgcggtggctcaagcctgtaa

SEQ ID NO: 423088 - DNA, 658 bp, Homo sapiens
gtgatgctctcagtagacttttcccccctgatggtgttgtatgctccctatgttgtttttgtttttaggatgttggcaatgtctgggagaagaaagataggcagctttgtttcattccctctaggcagacagcatccttttgttattcttggtggctcttaaatggatgctgagggaaaagctgctgttttcctctcatttctgaaaaatttatacaaaaatacattggatctagttgaatgtaatcaaaagaattgggggttttcatatgtgtagttgaaatgatgaaataaaaggacagagtttgcctttggaatttgttgtaacttgagcagtgggagtcattcattaaatttattcattcattatattcattcattaaattatttcaaatcgtaaccttgtttattgtttggaaaaaagtgaagctttgttcttgagtactttaaatgttgtttggtttgataattacctatagaaatgtagagcttgaagacatttttggctgtgccaggtaatgataaatccacttaaagggaactcaataacttagatctaagttttcctgaaagaaaaaaatgtatttttcctctgcattcaaaatgtagaaacaaagtatgtttatgaactttggcttttttgcttaggttattaaaac

SEQ ID NO: 423089 - DNA, 778 bp, Homo sapiens
ggatggatagacaatagagagattgcagtaatttgttttaaggaacgcaaagatggtgttgtgttgagcagttttaaatgttctgggcattgttctcattttactgcttaaatgagcagtatttcaaatttgtatattaaaaagcagtattttaaatttgtgtatgcagcagttttttatagctatgtataagtgcctttaaactcaataacctttttttccccgtattcaatagtgaattgaatgcaggaattataaaaacagatcaaaactatgaaaagatgatgtttaaagaagctttgaaaacagggttttttgagtttcaggtaggctgttgattcttttggtagctataaaacatgtcaatgtgaacattatgtattttcccccttttttcttcctgctatagcacaattactcgcctaaagtgtagactgaaaatcctgccagaaaaattttaaattcttcaataaattgtgattttaagttattatctttggtattttttctattgtgtccatttaatttaataattctgctcctagttaagctatgagcattaatataaaggagattaaatctaaaattcagctatactttccaggaaaacatttcaaaattgataaaaacaaaggcaaaattgtaattaattgccattaatttgagagcaagcgttttctgaggttttccacaaggtgtcagtatttcctcaagtttggcatttaaagtgcttaaagtaaaaatgtagctttacgcaatgagctgtgtaaaatatcac

SEQ ID NO: 423090 - DNA, 3716 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggaga

SEQ ID NO: 423091 - DNA, 1766 bp, Homo sapiens
ggactatagtagtaacctgcactttatcttagcaagcctttatgagtctattagctttacctcaaaattttaagccagaactatcatctttgtttttttattttctatctttaaacatttatctgtgaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 423092 - DNA, 3702 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctcttaatcatcatgtattatttagcttgatatacacactttaaaaattttggctatctagcgtggcattctgtatttcccagcaatcactaatacgttccttcttaccaaggtacggttcacggtaatagagaggatgggagtatctgagactgtacattgctgattccatcctggttttgacaagacttatcaggacacctaatgtcaagacacaaaatccctaccacattttaccaattagagagatatctgagtgactgtaactattttccctcctctttgagaaagcttagttcagtgtaagataagacaacaaaggtgttc

SEQ ID NO: 423093 - DNA, 2505 bp, Homo sapiens
  misc_feature (2261)..(2261): n is a, c, g, or t
  misc_feature (2269)..(2269): n is a, c, g, or t
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtganaaatggcnaagtgggaaaagaaatggcatcgcgtctgaagttgagaagtgtcaatcaaggcattctcaacattgccgctatgacaaagtcgacaaggaagcatggaatgcgagcgagaatgtaacatcctatgacggagagggtatcatgaaggaaaggacaagcaggaaaacgtacatacaatagccgtgaacacacaaataaagagtggagcaggcaggactcccttggtccctccctcccg

SEQ ID NO: 423094 - DNA, 2148 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattaggttggtaaacagataagggaaaggagcataatttgtcagtaagagttgtgatatttgatttacgtatttaaatgttttaataagatttatttcacagaattttg

SEQ ID NO: 423095 - DNA, 1604 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggtcttggtatagctgtgtacagctatcaaaatcatctcgatcacatgagatttcagagatccagttctcagtgtcaccttgaagatgacgatcttatgaagactagcaggtgattttaatccgacagtgtc

SEQ ID NO: 423096 - DNA, 2313 bp, Homo sapiens
ttttttttgtagagacagggtcttgctgtgttgcccgggctgctctcttaactcctggcctcaagtaatcctcttgccttggcttcccaaagtgctgggattacaggcgtgagccaccatgcttagctgatttgccctaatcctctgctgacattctgatatcagacaactaaaattataacattgggcagctattttgtatgatatatagggtagtggttcttaagcttattggtgagtaaccttcacttgggaagcttatttttaaaaatgtagaccttcattactttcctcctgagattttgaatcagtacctttgagagagggtccagtaaatctttgttttgaatgaactgatggttttgaagcaggtgacctggaggactgcatgtagaacacagtgatgtcaaggagtaaaggagagaacagaagtgagattagcactaatcacctctaatgccttatttccagtaaagtttagagaagaggaaaagctacttggcttgctcctttgaaggttttgtttccctcttaacacagaaattaaaaggtagaggagagatgctgaatgatgctttttttcttcttaatcttggggggtcattatgattaagttattgaatccatatcaccgtatgacagcacatgatgaaagaaaatcagatgtttgtttcaatcaaagtgaaacaaaatgagaataactatttgggcaaaacacttttatcactgctaagatattactagaactgagcagagaaatactcagagagagccatggcatagtactaattaataatggggtaccatttagcaactggaatattctctgatgatgcctgtttaattactcataggtgctaagtgaatgttaaaaattacggtgctggttgaataggccgagtagaatttgtgttagggcacatcccatggagatcttttttactgcttaattttttggagttacctcagtaacttaacaggcaggaatatggttttaatggaaaggaaaccatttgcctttaacagcattagtcccgctaagagaaagtttttgcttgtctagtttattacaggtctttgactttgtcagtatatggcaaatttagtataaaagatgattaattatcaaggctgatgaaatataggcagctgaaaagaaaattcttagcaattcataccttagaaggaaccctgaaggacaggacgccatagaaatcctgtttttttaaaaaagtaatttcaagtaagtttgcaaatgcaatgctagtaaaaagtatatagaggtatgtctttcacactatcttgttactattagaatttttgtagccatgtgcagaggagagaaaaggtgttggattttctgcagttctgattcagttctaaggaatttgggtgtgaaaagaatgtttgcaaaggagccaggcaccaaaggtgagaacaggaatacgaaacacaacatctgtaaatgactaaattcagagggaatttagtggggcatatctcttaaatggttttgaataatttggtgttttaaccaatgacttaatttaacttagtgggtatactgttcccagtcccattactgatttttattcctctgtgataacatacacccaaataaagactgctatgtatttgactttaaaactataaagatgtaaaaaaggttcactaagccaaacaccttagaaaatagcctcagctatttgctatgtttatattatacctgcataaaagtatttatgtatagatgtacttaccttacacagtaagtacctaaaatttgtaaattgaatacttttgaatgtaagcagttgaagtaaaacctgtagtgagttcttcagtcagtcaacactaaacctgttttgtaaatttgatgctagtattacactggactttctcaaaatgaagtacacctatatatgcatatagtatatgagcatgcgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcagttaacttaaaaaatatattgtgaccatttttataaaatacatgttcataaaacagatcaacatatttagcttatacagaaataaaattaagtcaatccactcacaaagaatttctattttgtaaaaatgtagcttgtatttcagtataataaaatctgatgtaagaaacaaatga

SEQ ID NO: 423097 - DNA, 343 bp, Homo sapiens
gcggccgcctactactactactactgctcgaattcaagcttctaacgatgtacggggacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423098 - DNA, 1924 bp, Homo sapiens
cttttctcccgccggctctaacccgcgcttggctaaggtccgcgggaacccgtgagccaccgagagagcagagaactcggcgccgccaaacagcccagctcgcgcttcagcgtcccggcgccgtcgcgccactcctccgatggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423099 - DNA, 1029 bp, Homo sapiens
tctaagtatctgtttctattttctagcatgttgaaacgttagacttcctgtttctgcttgattttgaatatactcctgtttgcttgtcacaggtaatcttgcatttctatgtagttgtagtttacagggagcaagtgcaggcagcaaccagtccatccctgttgtgaatgtggagacctctctggactcacaattaaaggctacctaatgcattccactacaagtgacgaaacctagctcccagaataacaagcaagacaactttcaaagtgactgtagttgaccagtgccttctgtgcatttatgtggtaagcttatggtagatttttcaaaagaatagtataaattattttgaattattcttgagaaggactgagtctccccgagggtgatgcaggttccatagtgtacacgtcaacagggtggttgcatgcattcctcaagtctgtatgactctaccaagatactgtgaagttgtccttctgattgcacacggggagaaaatgctgaaactaggtgagttaaaacggccttcagaatatgtttagatataatgtctttgttgaaatctggtaaaatgttcagatgactaacatagtattgctgtcttcaaggaaataatgtttggtcgtggctttagagctactgtgttcaacaaatcactgttttgttttgttttgctatggctctgggtgtggggaaccagtgttaagcagggagaggtatgagtattgtgggtggaaaaatgacatttaaagtttgcatgtagacagtttcatttgtaaacagataaagatttgaaatgtttcagagatgggactctgaaaagattggatggctttttcactcagagtttctcttttacattttccatgcgtttattaactgtaggacacctctggttcccagtggtctggtagcagtggtaacaccgtggggcaacccgtaaacacaaggctgtttatttctattctcttattggataattgtttgaatattgctgttgccattttctctaacaaccaaaaa

SEQ ID NO: 423100 - DNA, 2541 bp, Homo sapiens
ggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcaaaaaaaaaaaaaaaaaaaaaaaaaaaaaacaaaaaaaaaaaaaaaaaaaaaaaaaagaggggggggcccccaaaaaattcccccgagggggcgcgccaagatagtcatcgccgtgaccccggttttctgtgtgtgaccagaagggggcgccccataggagggagagcgccgagaataacaaaacagcagagacgacgcgcggagccgcggctgtaacaacaccacagcgcagaaggcgggaacaaccgcgcgcacaggggggaacccaggggaaaagcgaacccctccacgcgggggggggggggaacacactgttggcggggacacagatcacacctcacccggagatttattaagcgcccgcagagaagagagaaatatatccaccttctcagggcgatgctatacgcgctgtcttcaaccatgtgctccgtatttattattctgctgtagcgttacagacagttctgtggccacgccgccgctttac

SEQ ID NO: 423101 - DNA, 2300 bp, Homo sapiens
tctaagtatctgtttctattttctagcatgttgaaacgttagacttcctgtttctgcttgattttgaatatactcctgtttgcttgtcacaggtaatcttgcatttctatgtagttgtagtttacagggagcaagtgcaggcagcaaccagtccatccctgttgtgaatgtggagacctctctggactcacaattaaaggctacctaatgcattccactacaagtgacgaaacctagctcccagaataacaagcaagacaactttcaaagtgactgtagttgaccagtgccttctgtgcatttatgtggtaagcttatggtagatttttcaaaagaatagtataaattattttgaattattcttgagaaggactgagtctccccgagggtgatgcaggttccatagtgtacacgtcaacagggtggttgcatgcattcctcaagtctgtatgactctaccaagatactgtgaagttgtccttctgattgcacacggggagaaaatgctgaaactagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423102 - DNA, 1936 bp, Homo sapiens
cgtaaccgcgtgcgttggactagcggttcgtggagaatcctggtggaggcaccagaggagagcagcagaacgtcgtgcgctcctgacaatacagcccatggtcgacagcttcagcgctcccaggacgccgtctgctgccacatccgtcgcgatggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423103 - DNA, 2051 bp, Homo sapiens
ggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423104 - DNA, 2168 bp, Homo sapiens
ggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaaggcctaggcttaaacactggcatatatggagagaacagttgccactcgactcagagattgagtagacacccaaagaactgcagttcttaagccttaggagaagcgagagaaatggcagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 423105 - DNA, 2662 bp, Homo sapiens
  misc_feature (2337)..(2337): n is a, c, g, or t
ggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcactgtgtctatgatttttttttttttttttttgagtctcgctctgttgtttaggctagaatgcgggagccaagattacaccattgcactccagccggggcaacaagagtgagatcttggttctcaaaaaaaaaaaaagaaatctctgttctgcgaagtgaagataaataattttttaaaaaccaccctgttgtgatgtggaaacacaagagggggaaataaaactcagagttataaatttcctatttggtgcccatttatcggggataatggaggattataagaagncgggagttcgcctcctaagaagtgggttttataaaggccagcagaattggccctttagctttaaattggtgtcgcccgccctggggggcccttctaaaacccgtcggtcctccctcagggtaaaatccgtggtaggacatttttacatcctgtacaacacttaatcccggcaaagaagagcggcgactaggggacaagccgcaatagggctttcaacacatggcgcggtgccgcacggaggacacttggggaaaaccgggcggtggcacccggggcccgtgtcacacccacgcagagcactcccagaactgctcacccgcacgtg

SEQ ID NO: 423106 - DNA, 1208 bp, Homo sapiens
ggggacctcagtggtgtgggccgattgtccccaagggaaaggctagaggcagatgggctcccgcctgtgggccagaccccagcctacctcgcttattctgcgtgccgtgcttcttggccagggcgatttctctctggattcgattttccagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagtgtcactcttctgttgctcatagacaccgtcatcagtcagatcatgagtgtgaaaaactggaaatcccaaagcctcgaatggctgccactcagaaacttgttaaagacattattggtaagtatctagaaagcgtgttttgttgctttcctagttccagagctcctgcttcttatatctactttccaattatgggaggcatcattaataaccccagtggtattcgtattaacttgtattttgatgatattcttgtgacagtatttcttatgaggtctacctgaccgatggaaatttggaaattatttggaggtactccactgtaagtacttatctcttttgctgagccacttagattagctagttaaccattgggctagaaatggtattcatgagattgaagtagtcagctgctttctctacagattaaactctaagcctagtcagctgttctgtgaatgctgctgataataagagataccaggaatgaatgtatctgtgacttaaatcagtctgcctgccagtatgttagctcagaatttttattccatattaaggatagtacctttattacaatcttgcataaccaaatcttaaggttgtctgtagaagcattaatgactgctttaggttaaataggcttaagttgaaaagaagcacattatagtggattttttgatgtggagattgcctagatcaatctcaatgatatttttccattgacaatgtaaatacaatacctatacaatgaatgtggtctctgtatatctctcttgtgtgtaatttatatatgtttctgagccataattaataagtgtattataataaaattctatttgtaatgtgaa

SEQ ID NO: 423107 - DNA, 477 bp, Homo sapiens
tacaggatcttagttaccgttatgtagtggctataggtttacttaaaaggaataaatttggaatgctcatttggtttatttcctttctaattcttcatattatttttatgtgaggaatggagataatttccaacttttattatgttcttgtactttcattcattagcatagttatttgagttcccactaaatgtagggatttgtcctaattgccatgattaatacaatgatgatatgtatacatacaggtataccttggaaatattgtgggttcagtttcagactaccacacaaagcaaatattggagtatattgagccagacaaattttttttttgtttcccagggcatataaaaattatgtttacactatactatagtctatttaatgtgcaatagcattatgtctaaaaaatgtatatactttaagtaaaaaaatactttattgctaaaaaatgctaataatatctgagccttc

SEQ ID NO: 423108 - DNA, 1796 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423109 - DNA, 1846 bp, Homo sapiens
ggagttgagcgagagcagagaaaagttgaaaagaccgacaaagactgtgggaagttggcttttatccacactagggacggtcccaggaacgaggaactagtttgtgaatggctcaaagaaaagcaaaccgatgtccagggtcttgtgcaggatctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423110 - DNA, 1829 bp, Homo sapiens
acactggtcaggctggtctcgaactcctgacctcaggtgatccgcccgcctcggcctcacagggtgctgggattacaggcgtgagccaccgcgcccggctgcagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423111 - DNA, 2244 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctcatttggtttatttcctttctaattcttcatattatttttatgtgaggaatggagataatttccaacttttattatgttcttgtactttcattcattagcatagttatttgagttcccactaaatgtagggatttgtcctaattgccatgattaatacaatgatgatatgtatacatacaggtataccttggaaatattgtgggttcagtttcagactaccacacaaagcaaatattggagtatattgagccagacaaattttttttttgtttcccagggcatataaaaattatgtttacactatactatagtctatttaatgtgcaatagcattatgtctaaaaaatgtatatactttaagtaaaaaaatactttattgctaaaaaatgctaataatatctgagccttc

SEQ ID NO: 423112 - DNA, 1838 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagatgagtaatctggagtgaagtatttttaagagcactaacttgacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423113 - DNA, 1799 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423114 - DNA, 1493 bp, Homo sapiens
tgtgctgactctgaggatcccagttaggcgcgtctgcgtgtgtttttggctactgtgattggtattccaagtagcagataccttgttagaaggtaattctgctctgaccagaagagaggaacggttggcaccagacaaaaactgatgtctattttgtctatgtaatggttgttttaactttttctttttacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423115 - DNA, 1105 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattggtaagtatctagaaagcgtgttttgttgctttcctagttccagagctcctgcttcttatatctactttccaattatgggaggcatcattaataaccccagtggtattcgtattaacttgtattttgatgatattcttgtgacagtatttcttatgaggtctacctgaccgatggaaatttggaaattatttggaggtactccactgtaagtacttatctcttttgctgagccacttagattagctagttaaccattgggctagaaatggtattcatgagattgaagtagtcagctgctttctctacagattaaactctaagcctagtcagctgttctgtgaatgctgctgataataagagataccaggaatgaatgtatctgtgacttaaatcagtctgcctgccagtatgttagctcagaatttttattccatattaaggatagtacctttattacaatcttgcataaccaaatcttaaggttgtctgtagaagcattaatgactgctttaggttaaataggcttaagttgaaaagaagcacattatagtggattttttgatgtggagattgcctagatcaatctcaatgatatttttccattgacaatgtaaatacaatacctatacaatgaatgtggtctctgtatatctctcttgtgtgtaatttatatatgtttctgagccataattaataagtgtattataataaaattctatttgtaatgtgaa

SEQ ID NO: 423116 - DNA, 539 bp, Homo sapiens
gagaagagcaaaccaatgttcttttgccaccgatggagcattggaaaggccatagactttgccgcttctctagccaggcttaaaaatgacaataacaaatttacagctaaggtaacatctcattataataatatttctatattaataaaggttttatgatgctccattcaagcatgtttatttattacagtatgacttacttctcccttcacagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctatta

SEQ ID NO: 423117 - DNA, 1010 bp, Homo sapiens
tgtctacatcatgatgtatacagacagcaaggctatactttctggctccatgatgctagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctcaaaaaaaaaaaaaacaccaaacacaaacgacccgaaacaagatcaatacgacacaacaacaaagcacaaacgctgcaccacagacaacaaaacaacgcaggctccacacacacacttattcatcacacacgcgccgctgccaaaaaaccacaaagagacgacccgcacacaagacagaaacaacgacacagcaaggacgcatcgaagtacacaaacgaccaggacgagcgagacaaaacaagagcggaagaagaaagacgcaaggcaatcgagacaaacaccggccgcaacacaagcaacgccacaaatccacacgaacggccaaacatacgctggcgaggtacaaccccaaccagagccgacaccaaacactcgcccgacaggcagggacggagcgcgagccacacaacgcagccgaccccggccgcaaggaaccgcacaccagcgagagacgaacgagagagcggagcaga

SEQ ID NO: 423118 - DNA, 1836 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423119 - DNA, 1774 bp, Homo sapiens
gggaccggggtacggtgcggagtgcccttcgtcctgggaaacggggcgccggagagatggcggagttggacatcgggcagcactgccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423120 - DNA, 1814 bp, Homo sapiens
gggaccggggtacggtgcggagtgcccttcgtcctgggaaacggggcgccggagagatggcggagttggacatcgggcagcactgccagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423121 - DNA, 1937 bp, Homo sapiens
ggagttgagcgagagcagagaaaagttgaaaagaccgacaaagactgtgggaagttggcttttatccacactagggacggtcccaggaacgaggaactagtttgtgaatggctcaaagaaaagcaaaccgatgtccagggtcttgtgcaggatctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgaggtgattgatcacttaggctgttcacactttgtatatctgtttaagtgctatacaaacacatgaactagtgtcactcttctgttgctcatagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 423122 - DNA, 2308 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctcaaaaaaaaaaaaaacaccaaacacaaacgacccgaaacaagatcaatacgacacaacaacaaagcacaaacgctgcaccacagacaacaaaacaacgcaggctccacacacacacttattcatcacacacgcgccgctgccaaaaaaccacaaagagacgacccgcacacaagacagaaacaacgacacagcaaggacgcatcgaagtacacaaacgaccaggacgagcgagacaaaacaagagcggaagaagaaagacgcaaggcaatcgagacaaacaccggccgcaacacaagcaacgccacaaatccacacgaacggccaaacatacgctggcgaggtacaaccccaaccagagccgacaccaaacactcgcccgacaggcagggacggagcgcgagccacacaacgcagccgaccccggccgcaaggaaccgcacaccagcgagagacgaacgagagagcggagcaga

SEQ ID NO: 423123 - DNA, 1145 bp, Homo sapiens
gggaccggggtacggtgcggagtgcccttcgtcctgggaaacggggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattggtaagtatctagaaagcgtgttttgttgctttcctagttccagagctcctgcttcttatatctactttccaattatgggaggcatcattaataaccccagtggtattcgtattaacttgtattttgatgatattcttgtgacagtatttcttatgaggtctacctgaccgatggaaatttggaaattatttggaggtactccactgtaagtacttatctcttttgctgagccacttagattagctagttaaccattgggctagaaatggtattcatgagattgaagtagtcagctgctttctctacagattaaactctaagcctagtcagctgttctgtgaatgctgctgataataagagataccaggaatgaatgtatctgtgacttaaatcagtctgcctgccagtatgttagctcagaatttttattccatattaaggatagtacctttattacaatcttgcataaccaaatcttaaggttgtctgtagaagcattaatgactgctttaggttaaataggcttaagttgaaaagaagcacattatagtggattttttgatgtggagattgcctagatcaatctcaatgatatttttccattgacaatgtaaatacaatacctatacaatgaatgtggtctctgtatatctctcttgtgtgtaatttatatatgtttctgagccataattaataagtgtattataataaaattctatttgtaatgtgaa

SEQ ID NO: 423124 - DNA, 1159 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaattt

SEQ ID NO: 423125 - DNA, 1235 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatggataaaacccaggaggtagaattgctgggttgatagaagagaaaggatgattggcaaattaaagcttcagtagaggaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaattt

SEQ ID NO: 423126 - DNA, 2025 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatggataaaacccaggaggtagaattgctgggttgatagaagagaaaggatgattggcaaattaaagcttcagtagagggtacatgccgagcacaaatgggatcagccctagataccagaaatggcactttctcatttccccttgggacaaaagggagagaggcaataactggtgctgccagagttaaatttgtacgtggagtagcaggaaatcatttgctgaaaatgaaaacagagatgatggtgtagaggtcctgaagagagcaaagaaaatttgaaattgcggctatcagctatggaagagagtgctgaactggaaaacaaaagaagtattgacaattggtatgcttgtaatggcaccgatttgaacgcttgtgccattgttcaccagcagcactcagcagccaagtttggagttttgtagcagaaagacaaataagttagggatttaatatcctggcaaaatggtagacaaaatgaactctgagatccagctgcacagggaaggaagggaagacgggaagaggttagataggaaatacaagagtcaggagactggaagatgttgtgaaatttaagaacacatagagttggagtaaaagtgtaagaaaactagaagggtaagagaccggtcagaaagtaggctatttgaagttaacacttcagaggcagagtagttctgaatggtaacaagaaattgagtgtgcctttgagagtaggttaaaaaacaataggcaactttattgtagctacttctggaacagaagattgtcattaatagttttagaaaactaaaatatatagcatacttatttgtcaattaacaaagaaactatgtatttttaaatgagatttaatgtttattgtagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaattt

SEQ ID NO: 423127 - DNA, 1270 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgctgaagatgatggtaaagtagaaatgaatttatttttctttgcaaactaagtatctgcttgagacacatctatctcaccattgtcagctgaggaaaaaaaaaaatggttctcatgctaccaatctgccttcaaagaaatgtggactcagtagcacagctttggaatgaagatgatcataagagatacaaagaagaacctctagcaaaagatgcttctctatgccttaaaaaattctccagctcttagaatctacaaaatagactttgcctgtttcataggtcctaagattagcatgaagtcatggattctgttgtagggggagcgttgcataggaaaaagggattgaagcattagaattgtccaaaatcagtaacacctcctctcagaaatgctttgggaagaagcctggaaggttcccgggttggtggtggggtggggcagaaaattctggaagtagaggagataggaatgggtggggcaagaagaccacattcagaggccaaaagctgaaagaaaccatggcatttatgatgaattcagggtaattcagaatggaagtagagtaggagtaggagactggtgagagaagctagagtgataaacagggtgtagagcaagacgttctctcaccccaagatgtgaaatttggactttatcttggagataatagggttaattaagcacaatatgtattagctagggtaaagattagtttgttgtaacaaagacatccaaagatacagtagctgaataagatcacaccacctgagtcagaagcgggggaacataaacaagggggatgaggtacgccatggagaggagactcttttacctgtttaggaagtctctcatgcctagaagggaaagaaaaaagcacaagtatcaatatgaatcaaataagacttcaatgcatctgcgcccaacactgtagcagagatgggacatatcagtgaacaaa

SEQ ID NO: 423128 - DNA, 1180 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcagatggctctttgctttcattaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaattt

SEQ ID NO: 423129 - DNA, 2109 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgctgaagatgatggtaaagtagaaatgaatttatttttctttgcaaactaagtatctgcttgagacacatctatctcaccattgtcagctgaggaaaaaaaaaaatggttctcatgctaccaatctgccttcaaagaaatgtggactcagtagcacagctttggaatgaagatgatcataagagatacaaagaagaacctctagcaaaagatgcttctctatgccttaaaaaattctccagctcttagaatctacaaaatagactttgcctgtttcataggtcctaagattagcatgaagtcatggattctgttgtagggggagcgttgcataggaaaaagggattgaagcattagaattgtccaaaatcagtaacacctcctctcagaaatgctttgggaagaagcctggaaggttcccgggttggtggtggggtggggcagaaaattctggaagtagaggagataggaatgggtggggcaagaagaccacattcagaggccaaaagctgaaagaaaccatggcatttatgatgaattcagggtaattcagaatggaagtagagtaggagtaggagactggtgagagaagctagagtgataaacagggtgtagagcaagacgttctctcaccccaagatgtgaaatttggactttatcttggagataatagggttaattaagcacaatatgtattagctagggtaaagattagtttgttgtaacaaagacatccaaagatacagtagctgaataagatagagaatttttctctcaaagaaagtctaagtaggcagctcagaagtagtatggctggaagcaacctgatgatattgggacccccaactttcttcagtcttgtacccatcatcccctagttgttgatctcactcacatagttgaaaatcatcatacttcctgggttcatatcccagttatcaagaaagggtcaagagaagtcaggctcattcctttcaaagactctaattggaagttaaacacatcaatccccctcatattccattgactagaatttaatcacatggccacaccaagtgcaaggaaatctggaaaatataatctttattccaggtagccatatgactctttaaaattcagaaataatatatttttaaaatatcattctggctttggtataaagaattgatggtgtggggtgaggaggacattaaggtagacataggggagtgctgatgaggagctgtgaatggattttagaaacacttgagagaatcaataggacatgatttagggttggatttggaaaggagaagaaagtagaaaagatgatgcctacatttttcacttaggcaatttgtaccattcagtgaaataggaaacacaggaggaagagcaggttttggtgtatacaaagaggaggatggatgacgcatttcgtttcggatctgagatgtctgtggaacgtcctagtggagatgtccaaaaactcttctacatgtggttctgagttcaggacaaagatttgggctggagatagagatattgaaggcttatgcatagaaatggcatttgaatctatagagataaaaagacaaatcagaggaaatgtgtaaagtgagagaggaaaagccaagtactgaactggggggaatacctacatttaaaggatgcagtagaaagaagctaataaacaacagagagcagactaaccaaaagggaagaagaaaaaccaagagaattccaccgactcccaggagagcatttcaagattgaggggataggtgttgtgttgaattttgcagccttgagaatcaaggg

SEQ ID NO: 423130 - DNA, 1159 bp, Homo sapiens
gcacatgtgtgcactaccatgcccagctagtttttaaattttttgtagagatgaggtctcactctgttgcccaggctggtcttgaactcctgagttcaagcgatcctcctgtcttttctcctaaagttctgggattaacaggcgcgagccaccgcacctggccaaaaagataggtttcaatatgtaatgaaatctttggtttattgctcaataagttctttttgtttttgttttttttttgagatggagtcttgctctgtcacccaggttggagtgcggtggtgtgatctcggctcactgcaacctctgcctcccaggatcaagcgattcttgtgcctcagcctctcaagtagctgggactacaggtgactcatttttctattgtcctgaccgccaaagattttaacccagagaagtatgctgccttcactaggatattgtgtagaggtctgtataaaaattgtattaaatgctaatatacaaaatgaagaccttagtatagttacatagcagatttctacactgagaaagcaaagttcagccttgtgtctccccagcataatctttagtagcccttcacagactgtaaagacggcctttctcttttgctctgttgatacttctcttatttgggtaaatgatctaggggaagagaaggagcagttttatagctattgtagctcctgggtgttttgaatcacttcctacttttgatctgttacttctgttcacttccagtctagaattcccttagtaggttggataagttaagggccttatgacatggtaaactggttcgtatgtgtcaaggtctgtgtgtacagtcattttggggaaagaattatgccgaagcacaataacacatttcttagctggaatgctgagaagctagggaattctgattaactggttagtcacgattcagctagactcttttagtttcatctccattgttgaaaaatttatctaaaatataccagtctattttcttttctttttctttttctttttcttttttttttttttttggagacagggtctcactctgttgctcagactgggagtgcagcggcttcatcatggctcactgcagtcttgacctcccaggactcaggtgatcctcccacctaagcctcccatgtagcaggactgcaggtgc

SEQ ID NO: 423131 - DNA, 727 bp, Homo sapiens
tggagacagagtctcgctctgttgcctaggcgggagtgcagtggcgtgatcttggctcactgcaacctctgcctgggcaacaagagcaaaactgtctcaaaaaaaaaaaaaaaaaaaaaaaagaaaaagaaaagaaacgatactgtaaaaatatagcattatcatcttatgggactaccattgtaaatgtggtccctggttgaccaaaacgtcattatgtggtgcatgactgtactcgtatggaaatatccatagcagtgttactcacagtagccaaaacgtggcagaagcaacccagtgtccttcagcagatgaatgggcaagcaaaatgtagtctttatatacagtagaatattactcagcttaaaaaggaatggaatgttttgaatgtggcttttgttgggggggagaaaaggaatagaattctgatacatgctatagcatggatgaaccttgaaaccatgctaatgaaataagccagacactaaagggtaaatgttgtatgattccacttatatgagctatctagagcagacaaattcacagagttagacggcagaatagaggttcccaggggctaagcgaggggaaatggggttattgtgtaatgggtagagtttctgtttgtgatggtgaaacgtgctggaaatagtggtgatggttgtgcaacgctgcaaatgtacttaatgccactgaattatacactcagaaaatgactaaaattgta

SEQ ID NO: 423132 - DNA, 2628 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423133 - DNA, 2585 bp, Homo sapiens
  misc_feature (463)..(463): n is a, c, g, or t
  misc_feature (471)..(471): n is a, c, g, or t
agcttgtgcagtgcgtggcattgtagtatcctggatttcttctcccgtcacagtgcaagagaagtgaggactcggagctactgccagccgcctcctctgcttcctgccccttcatgcagcactatgctcactcttgcatgtatgcacatccaagtatttgcacacacacacacacacacacacacaggtctgtgtgtacatgcacacactcataggcaaagacttcttttcttcatgacagtttaacatggagttgcctccctccatttctggtgaggagcaggcaggcgtgccttccacacacagcttgctgctcacagtggcagcagaagcccgcaggagggaacctcattccctatgtggctgcaggttcactgctgtggtcctcttcagcctctagtcgcttgctgctagtggccctgctagagaaccggggtttcatgcacacttgcagtcagctgtncaggcctngatgtgtggcagcctatggatgtctatctgaacaagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423134 - DNA, 2648 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423135 - DNA, 2812 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgacggggtctccctcttatccaggctggagtgcagtagcgcaatcaccgctctctgcagcctccactcccaggcccaaaccatcctcccgcctcggcctccgagtggctgggacctcaggcgtgcaccaccacccgattaatttttgtattttgtgtggagatgggataccgacatgttgtccagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423136 - DNA, 2492 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423137 - DNA, 1950 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423138 - DNA, 621 bp, Homo sapiens
tgcaatcatgtcttactgcagccttaatctcctgggcccaagtgatcctccctcctcagctccctgagtagctgggagcacatgtgtgcactaccatgcccagctagtttttaaattttttgtagagatgaggtctcactctgttgcccaggctggtcttgaactcctgagttcaagcgatcctcctgtcttttctcctaaagttctgggattaacaggcgcgagccaccgcacctggccaaaaagataggtttcaatatgtaatgaaatctttggtttattgctcaataagttctttttgtttttgttttttttttgagatggagtcttgctctgtcacccaggttggagtgcggtggtgtgatctcggctcactgcaacctctgcctcccaggatcaagcgattcttgtgcctcagcctctcaagtagctgggactacaggcatgcaccaccacctactcttcattttaaatgtatctcttcaaagttttgtatttatgaaattctgaattttgtctcattagtggaaatattaggtatatgtttatcagaaatttataatatagaggcatataagtaaatgaaggtttttttctttttttgagacaaagtctcactct

SEQ ID NO: 423139 - DNA, 3109 bp, Homo sapiens
  misc_feature (664)..(664): n is a, c, g, or t
  misc_feature (707)..(707): n is a, c, g, or t
  misc_feature (729)..(729): n is a, c, g, or t
  misc_feature (940)..(940): n is a, c, g, or t
  misc_feature (1051)..(1051): n is a, c, g, or t
  misc_feature (1244)..(1244): n is a, c, g, or t
  misc_feature (1631)..(1631): n is a, c, g, or t
  misc_feature (1821)..(1821): n is a, c, g, or t
  misc_feature (2204)..(2204): n is a, c, g, or t
  misc_feature (2238)..(2238): n is a, c, g, or t
  misc_feature (2280)..(2280): n is a, c, g, or t
tcttcctactccagtaaggttgctcatgtttgtgatgcaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggtaactccctcaccttctgacttactgaaagtcctgacccggtgtcgctgggtggtgtgcggcagagctgtgcacataagcagagtggggggctgtggtagaggccagcgggcaggtgcttagagagggtttacagacggccacagtgatgatggacaagcaggtgcaggctggcctgatctagttagttactgggctcgagggcaggtatacacaggggctggtgctgacaccgaccgctggcaatgagaaatgtaactaccaagtggtctggaaggcttttctgggccagccagtgcattctttcttcctaggagaatttccctggaggaacaaattataaaggggaggttgttgctgagcatggggaactagattgtcaaaattttgctttgcttgtctccaggacaacagaaatcangcagtcagactcctgtcccacttagtgactgttgccacatgcngcagagccagctccttgctggngtctacctggcatgctgaccagcgtccatgtggcccagtgggcacctgctctgcccttgccaaactgggatggcaaatgggttttatttcttgtgctttccacgtggtggcctgcagcccgcccagctccttgcatttggcctgttcccagctccttgctcctctcctgaaggatacacttccagcgttgccttatctagatgcctgactnataacctggggctggagggcccagaaggactgtctcccatctgcacctgtcctacctgggggtacgggggcacctctgatatgcaggctttactcattcggcccaacctgntgccttcttcatttatccattcatttactcagtgtttcttgagctctgtttgttaggcattgcactggcagtggggatgcagtggtgagcaaatccctgccctcatggagtctgtaatttagtggagtagatgcacagaaaataataaatgacaagataattacagcccatgttaggtgctgtgacagaaggngttgaggtggagaatattgggggatgggtaggccagatctctaaggaggtgacatgtcagcggaaagatgagaggggccatttctctgcagtgctggtggcctggccagctgtgagcaggaagagtgggctgatcttgccctgaggacctgaacactggagactctggggccgcttctttcctaccatgggaatcctcactgcccacctacccccaacattagagtaaagacatattcttacaatatcagcaacatatgtgaatctgagttttgcattactgtgttgttcacagactaaaagtgctacctagatgacttagtatgacgtatgagaccttggggagggcaagtgaaagtgctgggaatgctgtaagggttcaaaaatncatgaatgaattaatgatgtcagcaaacaaggaagaagacgtgacttttttttcccttttttgagtttcactgtcgcccagggtggagtgcagtggtgcaatcttggctcactgcaacctccaccacgtgggttcaaacgattctcctgcctcagcctcccgagtagctgggaccataggcatgcaccancatgcctggctaatttttttgtatttttagtagaggcagggtttcaccatgttggtcaggctggtcttgaacttctgacctcaaatgatccacctgcctcggcctcccaaagtgctgagattacaggcgtgagccaccatgcctggccagaagacatgattttaatgagtgctttagtgagtcctcagccacccaaaaggaataaagcctgcgtggcaggtgccgggttacttatcccaggcagaagaggacttttgggaagagattccttcaaaaaaacaatagcagcatttctcaaaaagttaaacatcaagttaccatatgatttagcaatgctgtttctgggtatatacccaaaataattgaaagcagggactcggccnggcccggtggctcatgcatgtaatcccagcactntgggaggccgaggcgggcggatcacctgaggtcaggagttcnagaccagcctggccaacatggtgaaacccatctctactaaaaatacaaaaattagccgggtgtggtggtgggcgcctgttaatcccagcgacttgggaagccgaggcaggagaatcgcttcaacccgggaggcgggggttgcagcgagccgagattgtgccattgcactccagcctgggcaacaagagcaaaactgtctcaaaaaaaaaaaaaaaaaaaaaaaagaaaaagaaaagaaacgatactgtaaaaatatagcattatcatcttatgggactaccattgtaaatgtggtccctggttgaccaaaacgtcattatgtggtgcatgactgtactcgtatggaaatatccatagcagtgttactcacagtagccaaaacgtggcagaagcaacccagtgtccttcagcagatgaatgggcaagcaaaatgtagtctttatatacagtagaatattactcagcttaaaaaggaatggaatgttttgaatgtggcttttgttgggggggagaaaaggaatagaattctgatacatgctatagcatggatgaaccttgaaaccatgctaatgaaataagccagacactaaagggtaaatgttgtatgattccacttatatgagctatctagagcagacaaattcacagagttagacggcagaatagaggttcccaggggctaagcgaggggaaatggggttattgtgtaatgggtagagtttctgtttgtgatggtgaaacgtgctggaaatagtggtgatggttgtgcaacgctgcaaatgtacttaatgccactgaattatacactcagaaaatgactaaaattgta

SEQ ID NO: 423140 - DNA, 3056 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattcaactacttttaggtgggtgacgaattgtcccctctttctctaatactgctcattccaaagaaaatggggaaaaaataccttttttcaactgtgagggcgctagggaattattaaaagacctgtctgaaagttcaagacggccaagggcgcggtggctcatgcctgtaatgccagcactttgggaggccgaggtgggcggatcacctgagatcaggagtttgagactagcctggccaacgtggtaaaaccccatctctactaaaagtacaaaaattagctgggtgtggtggcacatgcccgtaatcccagctacttgctatttgggaggctgaggcaggagaattgctcgaaccagggaggcggaggttgcagtgagccgagactgcaccattgcactccagcctggacaaaagagcgagacttggtttc

SEQ ID NO: 423141 - DNA, 2573 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423142 - DNA, 2536 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccattttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtataggactgaaacagtgaccttatattattgctaagggaatatgagattaacttcctacaggggccaaaaccagagaaaggcttccagcaacttcgatgaaagtagtttggccacatgtcaagccaattgtttgtattatttatgtacctttttcataactggaattgccaaataagcatggagatctaaatgatgtacttgttagtgtattcattcatattgattgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactatattagctaatgatcaaagttgttaaaattataaatttatgatgcagaaataaaattggtatattttgatattca

SEQ ID NO: 423143 - DNA, 1284 bp, Homo sapiens
ctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaggtctgtataaaaattgtattaaatgctaatatacaaaatgaagaccttagtatagttacatagcagatttctacactgagaaagcaaagttcagccttgtgtctccccagcataatctttagtagcccttcacagactgtaaagacggcctttctcttttgctctgttgatacttctcttatttgggtaaatgatctaggggaagagaaggagcagttttatagctattgtagctcctgggtgttttgaatcacttcctacttttgatctgttacttctgttcacttccagtctagaattcccttagtaggttggataagttaagggccttatgacatggtaaactggttcgtatgtgtcaaggtctgtgtgtacagtcattttggggaaagaattatgccgaagcacaataacacatttcttagctggaatgctgagaagctagggaattctgattaactggttagtcacgattcagctagactcttttagtttcatctccattgttgaaaaatttatctaaaatataccagtctattttcttttctttttctttttctttttcttttttttttttttttggagacagggtctcactctgttgctcagactgggagtgcagcggcttcatcatggctcactgcagtcttgacctcccaggactcaggtgatcctcccacctaagcctcccatgtagcaggactgcaggtgc

SEQ ID NO: 423144 - DNA, 2561 bp, Homo sapiens
ccgtctattttcctacgactccagctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423145 - DNA, 1751 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423146 - DNA, 2997 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423147 - DNA, 2512 bp, Homo sapiens
ggtcccagctcacctcacacggtgggctcaagcctcagcgtgaagtgactagtggaacatccctgcagagggacttacactcattgtgcactgagtgatgctggatgcgatacgtgttggctagccagaccgagatgcctgcacctggaggcactcaggcaggactttctgcgaacatgccacatttcgtcagcacgcggagacctcgctgtcggcgtactaggaggcctttgtcaatgcgcaggatttcgagaccaagccgatgccatgtcctgatgcgacacggcactctggaatgaggctcgatcttggccttatggctgtcataagtcgctgaaacaggcttccctggcctctgggtggattgtcatcagtccagaactggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctggcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423148 - DNA, 2663 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagaacgcgtaggagaacgcgtcaaaatcg

SEQ ID NO: 423149 - DNA, 2719 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccaccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423150 - DNA, 848 bp, Homo sapiens
aggaagaagcaccacaaggagtgtgaggagctggtgaggactcggggaggcaaggggcccctgactctttctctctccctgctgagcccccaaccctctgaaccaccaagcctttgtttttggcagctggagcaggcccaggcggggacctttgccttccctctacatgtggactactcctgggtaatttccacagagcctggctctgacagtgaggaggatgaggaagagaaggtgggtcccagccctgtccctcaggcctctggatggcagaaggaaagagccagattgggcctggtgtgtgttggcgggggcggtgaggcggggggacagggctacaccggaggaaccaggctgtcctcatcctcaatcttttgctctggcagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagacagttggatgcccagataaatgctcaccatgccattcacagaggacctgtatatgctggggcactgagctgagtgcatatgttagtccgtactatccttatgatgacctcccaggaaggggttctcatcttccccttacagataaaagaacagaggtgttaagtcacatgtttaagatcccacagctaataagtctctgatgtaggattcaaatctcagcccatcttattccaaattcctcaatgctccacttaacaagagagaa

SEQ ID NO: 423151 - DNA, 3168 bp, Homo sapiens
  misc_feature (66)..(66): n is a, c, g, or t
  misc_feature (1801)..(1801): n is a, c, g, or t
  misc_feature (1833)..(1833): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaagtggggttgttngccagcaacgcaaggggaacccccacgccgangagaagacaaaacaaagggaaaagggagggggggtggtgtgcgaggtgggggtggggtggggggtgctgcgagatgggagtggtgggggggggggggggaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423152 - DNA, 2970 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagaatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423153 - DNA, 1932 bp, Homo sapiens
ccctcaggcctctggatggcagaaggaaagagccagattgggcctgcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcggggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttaaaaatgg

SEQ ID NO: 423154 - DNA, 814 bp, Homo sapiens
  misc_feature (66)..(66): n is a, c, g, or t
gaaaaggaagtgtggagtcaagtatggctgcctgaccatctcacacagcacgataaaccggccccnggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggtgagaacccctccaagggccacttat

SEQ ID NO: 423155 - DNA, 1505 bp, Homo sapiens
  misc_feature (946)..(946): n is a, c, g, or t
catcgttgtggtcccttgcccctcgctgtgtgtcgtcattgtattgtgcttgttccgtctgtcttataagagaggatcgtttgttgtcatccggattgcggtccctttctgctcgtgtgttgtgtctctttccccgtgtgtgttgttgtgtcgcgcctcgttctgttttgtctgttctgtgcgtttttttgtgtgtttcttctctctttctttctgtgtctgtttgcgttttgtgttgtttgtgtgttttttttagtatggtctgaataaaatccagcatagatgtattagttttattctgggtataatggctcggtgtctgtgtcccaacagctttcttcttaagcgcaaaccacccttaagtgaaacttgccatttgtttttgtgttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatctaaaagttggtgtccatccacatacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggcggacgcgtgggtcgancccacgcgtttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacta

SEQ ID NO: 423156 - DNA, 837 bp, Homo sapiens
  misc_feature (717)..(717): n is a, c, g, or t
tgcttgatctaagtcattaatctactagaagaggggaatgagtatctgtttatagggcagtttttatcctccttggagtatttttcattttctgatccaccccaaagccccagataaattcctttgtacctttatgaactaacttgagtatatattgccttccccctttcctgcccatcttccccacccccatccccaggtatgattaacaatgcactaaccatgtactaatgcaatagatcttggctttttattctcttctgtttgtgttgtttggctgtcattttcaatgcagtgctgaagactgtgccctttactgctcgcaccgccaagcgtggctctcggtttttctgcgaacctgttctcactgaggaataccattactaaactattactctttctcacctgatgctcttaaaaggttgctacaggttttttgatgtcttatgtccccctctgtgtgtctgtcagggcccaccaacatgctagcatggaattgccatctccatcatgttatattttgtgttgttctcatgctgcatggttttgcatttcaattattattgctcactcactggccactttcaatacatgtatgtattcacattgctgtaacagtctggatgtgtttgacagctgaattcatagaattgttcacagaaattttcagaaaaatagagcaaaaatattaagagcacttctttgagaatcagtatntggtaccaagtagattgcttataagatttttgagctaatgtccttcaacatatccattaataacataactgctatacctaacatgtattaagaacttactgtgttcaggttggatgcagt

SEQ ID NO: 423157 - DNA, 1462 bp, Homo sapiens
ttgttgtcctggactcaagctgtaccccccgcctcagcctcctgagtagctgggactggaggcacaaatcattgcatctggcattcttgaaatttttaatagagaaatatgctctgacagtgatatactagagacataagtgcatttataatggtgtaagtttcattaggtagatacttcgggtttttggttttaaatcaatactgacagttccctaacttgtctcccaatgctttgtgtttctttttttttccatgttaattttagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctggtgcaaatgctgccattgtttaattgttgatgatgctgcataagaatccttaaggtagaagcaatcttgaccttttttatttttgcaggcccctgccagtgcccttctccagactatattcttaaaaattaaagtgctttggtttgtagagttgactgtatgtatctccaaaatgaatatgcagcagtgattttttttttcctccctgatctctttccctgctttggtaattctgtgagggtgtaatcatattggggctgtccttggcaggttaggtgacatacaagaacatgcggttccacagcagtcctgtcattctcgggtaagaacatcaaagtgagttgcagcacttctgcattcatacacgtaaatcttaatctggaaggaagatagaatctaccatagtgaatttctccagaagttttacgcttgagtgcacccagatctgtaggcgttgacccaatccagttgccctagggaaattctagacccaggagatcctaaccgggctgtaatttcccagatcacttctaacctgaagcagacgtaccaatgactccttaccttgcagagcctatgcttaggatgccaagtgaatttttcatttgaattgcttcagtgattataaaacatgaaacatagctttgcagatttctaaccctttttgtga

SEQ ID NO: 423158 - DNA, 8040 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423159 - DNA, 8303 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactggtgagaatctgaccagggagtttttgtacctcacattccaatgatgcagggattgagcctctctgttggactctttctcggcctgcttttaagttctaagtgtgatggcttgggcaagggtatttgctgatgattgtatttgctttgagtgttgggctgtccttcccttacccctgtcttggcctttgagttactcagttaaacccattttgatctgaagcgactgaaagcaggtcctggccaggtaacattacagcctttgaaggattaagatctttagaactaattgctcagaggatgaagaaccacaaagctgcatatgaggcaaaagtgtaattctggcctttcattaccagtgtgggctaggaagcagaggcttgagaggattggggtatgcaaaactattttttccttaaatttaagagtagaggctgggcatagtggctcacacctgtaatctgtaatcccagcactctgggaggccgaggtgggcaaatctgttgagttcaagatcaccctgggcaatgaagcaaaatccccatctctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423160 - DNA, 5436 bp, Homo sapiens
atagctttatgtcaccctactttagtaggccacctctattccttctgaatgtcatgcccatgttcaactatcagtaattccatgttggagcaaagctgtgaggcaggacatgaatacaaaggcttaggtcctcccactgtcttatctcattcacgcatcttcaccggtagctctgttccatgtcaaacccaggctatttcttctgtgatcagatcatatcttgacctgcttctttggtcaggatgatggcaccagaaatactaacagcaaatatcattggaaaatgccactgtttttaaattgggggggaaaaaaggatcaaacttttcaaagtaacctcctgggcacagtttttgatgcctaataagaaacgaacttctctccagtgtctagttgattagaaaagagacaagggaaacacatactctaattggacgtagccattgactcctgtgctgagattgacatggaattgggtatgtgtttattttgtggcataactattctatgaattgcacttatgtatgttcttctatctctgatatcaaaggacatagagtgtcattgcctgctctgcagtgtacttacccaccagtgcttattaacaggctagaaaactgtcatctgcttggctgatgtttgctgtcagttttgctgttggactatatctatctttctggagccaatcttcaaagcagcttggaactgggtggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423161 - DNA, 4857 bp, Homo sapiens
tgcttgatctaagtcattaatctactagaagaggggaatgagtatctgtttatagggcagtttttatcctccttggagtatttttcattttctgatccaccccaaagccccagataaattcctttgtacctttatgaactaacttgagtatatattgccttccccctttcctgcccatcttccccacccccatccccaggtatgattaacaatgcactaaccatgtactaatgcaatagatcttggctttttattctcttctgtttgtgttgtttggctgtcattttcaatgcagtgctgaagactgtgccctttactgctcgcaccgccaagcgtggctctcggtttttctgcgaacctgttctcactgaggaataccattactaaactattactctttctcacctgatgctcttaaaagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423162 - DNA, 7045 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaagtgaccatgtcattttcaagtgtcaagaatgtagactttggtactgaaacctgtctacatt

SEQ ID NO: 423163 - DNA, 5025 bp, Homo sapiens
atagctttatgtcaccctactttagtaggccacctctattccttctgaatgtcatgcccatgttcaactatcagtaattccatgttggagcaaagctgtgaggcaggacatgaatacaaaggcttaggtcctcccactgtcttatctcattcacgcatcttcaccggtagctctgttccatgtcaaacccaggctatttcttctgtgatcagatcatatcttgacctgcttctttggtcaggatgatggcaccagaaatactaacagcaaatatcattggaaaatgccactgtttttaaattgggggggaaaaaaggatcaaacttttcaaagtaacctcctgggcacagtttttgatgcctaataagaaacgaacttctctccagtgtctagttgattagaaaagagacaagggaaacacatactctaattggacgtagccattgactcctgtgctgagattgacatggaattgggtatgtgtttattttgtggcataactattctatgaattgcacttatgtatgttcttctatctctgatatcaaaggacatagagtgtcattgcctgctctgcagtgtacttacccaccagtgcttattaacaggctagaaaactgtcatctgcttggctgatgtttgctgtcagttttgctgttggactatatctatctttctggagccaatcttcaaagcagcttggaactgggtggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagctgtaatctgtaatcccagcactctgggaggccgaggtgggcaaatctgttgagttcaagatcaccctgggcaatgaagcaaaatccccatctctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423164 - DNA, 3328 bp, Homo sapiens
  misc_feature (946)..(946): n is a, c, g, or t
catcgttgtggtcccttgcccctcgctgtgtgtcgtcattgtattgtgcttgttccgtctgtcttataagagaggatcgtttgttgtcatccggattgcggtccctttctgctcgtgtgttgtgtctctttccccgtgtgtgttgttgtgtcgcgcctcgttctgttttgtctgttctgtgcgtttttttgtgtgtttcttctctctttctttctgtgtctgtttgcgttttgtgttgtttgtgtgttttttttagtatggtctgaataaaatccagcatagatgtattagttttattctgggtataatggctcggtgtctgtgtcccaacagctttcttcttaagcgcaaaccacccttaagtgaaacttgccatttgtttttgtgttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatctaaaagttggtgtccatccacatacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggcggacgcgtgggtcgancccacgcgtttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423165 - DNA, 5834 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactagtaaaaaaaaaaagaaaaaaaaaaaagaaaaacacaaaatgaatgaaaacacaggcgacaaccaaaagctcgaatagagagggagaagagacaacacaaaaaaaaccgcactagacaacacgcgaggaatacaacagacacaaaaacacggggaacagaacacgtagagaacagaaaggcaaacaaggacaaagagaca

SEQ ID NO: 423166 - DNA, 4099 bp, Homo sapiens
  misc_feature (2077)..(2077): n is a, c, g, or t
  misc_feature (3979)..(3979): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagtgctgaagactgtgccctttactgctcgcaccgccaagcgtggctctcggtttttctgcgaacctgttctcactgaggaataccattactaaactattactctttctcacctgatgctcttaaaaggttgctacaggttttttgatgtcttatgtccccctctgtgtgtctgtcagggcccaccaacatgctagcatggaattgccatctccatcatgttatattttgtgttgttctcatgctgcatggttttgcatttcaattattattgctcactcactggccactttcaatacatgtatgtattcacattgctgtaacagtctggatgtgtttgacagctgaattcatagaattgttcacagaaattttcagaaaaatagagcaaaaatattaagagcacttctttgagaatcagtatntggtaccaagtagattgcttataagatttttgagctaatgtccttcaacatatccattaataacataactgctatacctaacatgtattaagaacttactgtgttcaggttggatgcagt

SEQ ID NO: 423167 - DNA, 3898 bp, Homo sapiens
  misc_feature (2077)..(2077): n is a, c, g, or t
  misc_feature (3873)..(3873): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagtgctgaagactgtgccctttactgctcgcaccgccaagcgtggctctcggtttttctgcgaacctgttctcactgaggaataccattactaaactattactctttctcacctgatgctcttaaaagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgttcaggaggttttctgttgcggtcacccatgatggcgggcctncccatttgggccaacttttcctggg

SEQ ID NO: 423168 - DNA, 1275 bp, Homo sapiens
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcaggtatgttggagcttctggttcttttaaaaaaaacctgaattaatcagactcagaaatgactgctgggtgcagtgtacaccgcttgggcgaagggtacaataaaagcccagacttcatcatcctacaatttatctgtgttaccaaaagctgcttgtacccctaaagctgttgaaatttttttaaaaaagaagaaaaaccaacca

SEQ ID NO: 423169 - DNA, 1122 bp, Homo sapiens
gtagtagcatgatcagcactgaattcaggccatctctgagccagtggccatgctctcagccctgcctccaatgctgcctcccacatgaaaattaatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423170 - DNA, 479 bp, Homo sapiens
tcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacaggtaagaagccttggcaggaggactgaggaagttttggaatatttgtatttcttcttttgccaactgtccacttctgtcctttgtccgtttttgttggcatgttctttaagaattggttttcttgagtagttcttaactgtttacattttgagattaaatttataaatcctcatttcacatatgttgaaatatttttcccacatgtcaatgaggacattttttggtttttgaaaacagtcctttgtccttttaagtgtgttgttttcagatggctttatatgcacatggcttattgcagga

SEQ ID NO: 423171 - DNA, 660 bp, Homo sapiens
acagaaataatctatgtatttttctctcaaagtcctagaatcctaccagtattacatcctgttttgtttgattgtaaatattgaaggcaaatgttttatgtctttgattcaatgctcagtgagtttgaagggcccattagctgacttttctacacaagctgctttgattggctgccagctggcctttgtcctgcttagacacatgctattaaaggttgctattctctcactggcactctcccctttacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattac

SEQ ID NO: 423172 - DNA, 612 bp, Homo sapiens
acagaggggacaaaaaatagttgcattgttgtcttttttttttttaattcttttcctcatagttgtttatcaaagtgagtataatttgaatctatcagtgattctgatcattgtgttctcttttggtgttttctgttttgtgtctggtggggctacagtgctttacaaagaaattggataccttgtgacctttttgttgagtagaaagggagtctgccaaagcgacaaggcatcacctttgctaaaatgcaagtctgattgttcaaagcagatcatctcacatgtcccaccatagaacttcagaatttcccgcctctcatctaaccgatttgatgtttaagtgacttctgtgggtgttttggtttaatcagatactaggaattgagagaaagtcatgaaaaaaccatagtggtattatttggtctgcctgcaagttaccaatttggaagcctgctgtggaatgtgacatcttttctctctttattttttttaaacagaacgctatgaacctacctcctgacaaagccaggttactgcggcagtatgataatgagaaaaaatgggaactgatttgtgatcaggtaagaaacagtgacactttcttttatgaaa

SEQ ID NO: 423173 - DNA, 5567 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacta

SEQ ID NO: 423174 - DNA, 8087 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423175 - DNA, 7985 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttg

SEQ ID NO: 423176 - DNA, 4887 bp, Homo sapiens
  misc_feature (2077)..(2077): n is a, c, g, or t
  misc_feature (4861)..(4861): n is a, c, g, or t
  misc_feature (4887)..(4887): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcattatctttcttgtacatcattatataantgtaaagctcattgatagcatttacn

SEQ ID NO: 423177 - DNA, 3876 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacaggtaaaagatatttcttcactgtggcccatggagatcccactggcctcacctagactgggatgcatgcagattttgcagcttcttttgtccagggttgtcaagttcattagttgactttattcacacccagagtgatgcagagaggctttgaagtccatttacagcagcatgtatactgccccaatactctgcattgggaaccctgttaagttttcagcagagctcctttcattttaaagggatttccattgtttatttgatatgtcatcatgctccattttttttttcctcgtggccacacctagccacctgcctgatt

SEQ ID NO: 423178 - DNA, 2267 bp, Homo sapiens
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctggtgcaaatgctgccattgtttaattgttgatgatgctgcataagaatccttaaggtagaagcaatcttgaccttttttatttttgcaggcccctgccagtgcccttctccagactatattcttaaaaattaaagtgctttggtttgtagagttgactgtatgtatctccaaaatgaatatgcagcagtgattttttttttcctccctgatctctttccctgctttggtaattctgtgagggtgtaatcatattggggctgtccttggcaggttaggtgacatacaagaacatgcggttccacagcagtcctgtcattctcgggtaagaacatcaaagtgagttgcagcacttctgcattcatacacgtaaatcttaatctggaaggaagatagaatctaccatagtgaatttctccagaagttttacgcttgagtgcacccagatctgtaggcgttgacccaatccagttgccctagggaaattctagacccaggagatcctaaccgggctgtaatttcccagatcacttctaacctgaagcagacgtaccaatgactccttaccttgcagagcctatgcttaggatgccaagtgaatttttcatttgaattgcttcagtgattataaaacatgaaacatagctttgcagatttctaaccctttttgtga

SEQ ID NO: 423179 - DNA, 4780 bp, Homo sapiens
  misc_feature (3888)..(3888): n is a, c, g, or t
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggacngctcagcactccctaaaaacacaccatggaggccactggtgactgctggtgggcaggctggccctgcctgggggagtccgtggcgatgggcgctggggtggaggtgcaggagccccaggacctgctcaaaagacttctgcctgaccagagctcccactacatgcagtggcccagggcagaggggctgatacatggccttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccgtggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcagtgccaaacaactgatcgctgccctccgttacctcaagaacagcaaccct

SEQ ID NO: 423180 - DNA, 2020 bp, Homo sapiens
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctg

SEQ ID NO: 423181 - DNA, 4118 bp, Homo sapiens
  misc_feature (3235)..(3235): n is a, c, g, or t
gctacctctgccagcgcctgatcaccttcccaggataagcctggctctggatgacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggacngctcagcactccctaaaaacacaccatggaggccactggtgactgctggtgggcaggctggccctgcctgggggagtccgtggcgatgggcgctggggtggaggtgcaggagccccaggacctgctcaaaagacttctgcctgaccagagctcccactacatgcagtggcccagggcagaggggctgatacatggccttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccgtggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaaaactgg

SEQ ID NO: 423182 - DNA, 881 bp, Homo sapiens
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaagtaagggaccaacctcttgccccttttgggttctctgttttcttctgtcctcatcctgcacccagaccctgtttggaactctggcctcatcaccccaagccctcagaaccccccggtcctcctccttttctgctgctgcacatcccttctgcttcctccttggtgcaatccccag

SEQ ID NO: 423183 - DNA, 496 bp, Homo sapiens
taacctgaggtaggggaatgagactagagaagttggtgcccaaggagctcctgcattgctgaggggctgtggtttctcagtgagctcagagaaggggtctaggcagctcatctccctttgaacttcttcccaccccccagcgcagcagaatgtgctgtctgctttcacccagcttcctccctgggaaaccaggcagcccaaccctcagcagccgaactccctcctccatatatccccgtgggctaccaggcaggccctggacaaaggccgcctgagcaggccaggcccctcccatcccaccctgctgtgtcagggcctggcacactccttagtgcggtgtcggcagctacctctgccagcgcctgatcaccttcccaggataagcctggctctggatggtgagtgagtatgcctgccttcccctgtgagtgccagcccaggcactggccacgcttgggggaaggggtggggaactgtggcgaggctgagctctgca

SEQ ID NO: 423184 - DNA, 4771 bp, Homo sapiens
  misc_feature (3888)..(3888): n is a, c, g, or t
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggacngctcagcactccctaaaaacacaccatggaggccactggtgactgctggtgggcaggctggccctgcctgggggagtccgtggcgatgggcgctggggtggaggtgcaggagccccaggacctgctcaaaagacttctgcctgaccagagctcccactacatgcagtggcccagggcagaggggctgatacatggccttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccgtggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaaaactgg

SEQ ID NO: 423185 - DNA, 4884 bp, Homo sapiens
  misc_feature (4001)..(4001): n is a, c, g, or t
ctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggacctggtgagagctatgagttctgctttttgggaggaggatcctggcttcaattacttggtcaagggaaacaactgcatatccagcaatctggggggtagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggacngctcagcactccctaaaaacacaccatggaggccactggtgactgctggtgggcaggctggccctgcctgggggagtccgtggcgatgggcgctggggtggaggtgcaggagccccaggacctgctcaaaagacttctgcctgaccagagctcccactacatgcagtggcccagggcagaggggctgatacatggccttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccgtggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaaaactgg

SEQ ID NO: 423186 - DNA, 1188 bp, Homo sapiens
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggagagtgaaaacatcacggctgcagccctggctacgggtgcctgcatcgtaggaatcctctgcctccccctcatcctgctcctggtctacaagcaaaggcaggcagcctccaaccgcccttccattctggttctgtggcagcaacattcaagggattgaaaaccccggctttgaagcctcaccacctgcccaggggatacccgaggccaaagtcaggcaccccctgtcctatgtggcccagcggcagccttctgagtgccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctg

SEQ ID NO: 423187 - DNA, 621 bp, Homo sapiens
ggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggccgaaggaatcccggcggccgaaggaatcccggcggccgaaggaatcccggcggccga

SEQ ID NO: 423188 - DNA, 892 bp, Homo sapiens
gagacggagtctcgctgtgtctcccaggctggagtgcagtggcagagtgagactcctcaaaaaaaaaaaaaaagttcttgaataaagaaggattattcttccaagaatccaacgtagctgagtaccttgtaacaagtgcagtccacttactgttatactcaaagacaagtttgtatattgattggttctttcaaattcttcacctcagtttcttcttgagtacttgtagaaagaatgatgatactgatggctattttgatttcttttttacgttcttttctcgtttcatttctggaaatatttagtaattaaatgtattatatgttaaagtctgttaacttatactgagctatgttaagaaattatttccaatgtgtttgtaccaacaggttggcgatagtattgttcacaaagccagagagaccttggaacgagctattaaactggtgaatgataccaagaaatggggggctagggttgtatatggcgatactgacaggtaatgggtttttggttttgtagttgtcttttgcatctctctagatcttcatttcagtgtttaaaatggcttaagggaatcttttctaaaaacagagttctgtctgagtcctttccagtccttacgatctcatgatcagagttaacacagatcctgatttaccagataggatcgtaagagacagtttgtgtcctgagccacaaactgaagatacctatggcttccctccaggtagctctaagccaagtagatagtgatctgtaaactaactgtgtacacaggagtctagtttatttaaagaaactacttttaatgtgaataattcctctaatatagctgtaactctctgaatttaagtgtatatcttaaaataaactgtttttgaaggacaat

SEQ ID NO: 423189 - DNA, 620 bp, Homo sapiens
actatcattttatcgtatatcgaaatgtgggagaggtaaggggctactacgtttacccaccatccctaccactgggattggaccccaacttgtctcctgcccaagtggctccccctgtattatgggggggactttgaccaaactctacccaccttggaacgagctattaaactggtgaatgataccaagaaatggggggctagggttgtatatggcgatactgacaggtaatgggtttttggttttgtagttgtcttttgcatctctctagatcttcatttcagtgtttaaaatggcttaagggaatcttttctaaaaacagagttctgtctgagtcctttccagtccttacgatctcatgatcagagttaacacagatcctgatttaccagataggatcgtaagagacagtttgtgtcctgagccacaaactgaagatacctatggcttccctccaggtagctctaagccaagtagatagtgatctgtaaactaactgtgtacacaggagtctagtttatttaaagaaactacttttaatgtgaataattcctctaatatagctgtaactctctgaatttaagtgtatatcttaaaataaactgtttttgaaggacaat

SEQ ID NO: 423190 - DNA, 609 bp, Homo sapiens
gggatgacacaaagaataatttagcttgaggctgggcgccatggctcacacctgtaatcccagcactttgggaggccaaggcaggcagatcacttgagctcaggagttcgagaccagcctgggcaatatagtgaaaccctgtctccaaaaaaatatgaaaaatagctgggtgtagaggtgcacgcctgtagtcccagctactcaggaggctgaggtgggaggattgcttgagcctgggaagtcaagactgcagtgagttgagattgggtcactgcaccccagcctgggtgacagagtctcactctgtctcaaaaagaataatttcgcagggcatggtggctcatacctgttatctcagcactttgggaggctgaggcaggaagatcgcttgagcccaggagttcgagaccagcttgggcaatatagtgagacctcatctctattaaaataatttcttgtgaaaaaccgtctcagcggctgcccccgcctcctctgctggatgtgaaatggcggtcggcgaggcaagtgtgagcatcgcagctcctgccaatcctgcatagccgccaaaacggccccgaacactggcgcccccctcccgcaagcccctcg

SEQ ID NO: 423191 - DNA, 424 bp, Homo sapiens
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgaggcaagtgtgagcatcgcagctcctgccaatcctgcatagccgccaaaacggccccgaacactggcgcccccctcccgcaagcccctcg

SEQ ID NO: 423192 - DNA, 10965 bp, Homo sapiens
  misc_feature (317)..(317): n is a, c, g, or t
gcacgagactgcgctcgcctccctcctcacgcgggcgggattttcttgccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423193 - DNA, 11057 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423194 - DNA, 10796 bp, Homo sapiens
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagtgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423195 - DNA, 2525 bp, Homo sapiens
gagacggagtctcgctgtgtctcccaggctggagtgcagtggcagagtgagactcctcaaaaaaaaaaaaaaagttcttgaataaagaaggattattcttccaagaatccaacgtagctgagtaccttgtaacaagtgcagtccacttactgttatactcaaagacaagtttgtatattgattggttctttcaaattcttcacctcagtttcttcttgagtacttgtagaaagaatgatgatactgatggctattttgatttcttttttacgttcttttctcgtttcatttctggaaatatttagtaattaaatgtattatatgttaaagtctgttaacttatactgagctatgttaagaaattatttccaatgtgtttgtaccaacaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423196 - DNA, 1928 bp, Homo sapiens
gccctgcaggcagtcagattttatggttatctcccttattccctgcaaatcgctgttatcctgttcttttcaaggtgctcagatttcatattgttcaaacacacatgctttacaaacaatttgtgcagataacgcaatcaccacagggtcctgaggcgatatacatcctcagcttacggagatgacggaattaaaagattaaagacaggcataggaaattataagagtattgattggggaagtgataaatgttcatgaaatcttcacaattcatgttcagagattgcagtaaagacaggcataagaaattatgaaagtattaatttggggaactaacaaatgtccatgaaatcttcacaatttatgtttttctgctgtggcttcagcaggttgcttttctcttctggaatacgaaaaagagtaacttttttatgattggcatatgagaatatagtctaagtactttgaaaacgtgtttatagttcatgtaagagacattctttggtaattgggtagcttatgtagattttaataggattccattgtaaatgaaagttaatcttaggaattaaatgaatccttagggaaatttgtactctatctttacaaaataatatcctttagaaatgtctcaacatagggtagtctaggcttccaagagattaaaattaatgaaagtttctgtaatgtatgtctgccagtaatctgtggtagtctagaaagtagggattataaaaatttgttgtttgcatacacgcataaaaactttcctattattttttgtatttctcttatgctttcagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423197 - DNA, 8523 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtattgttttgtatatctgatttttccagttttattcagagagtcgtttcatgctattgcagataatagtgaagataaaagtaaaggtaggaagaaagcgaatcccttcctatgacccttgaaagcagagttactcttgggaagattttatactcacttcccaccaccatcactattttcatcagacaagggataggaaaagcagtgttctgttctcaagattgaggggccagtgaaagacaaatatttgtttagcctctaactaacttcccagttgtacttgaggttggtttttctgtggtgctgaaataatggagaactgtataaagttccattgtattattcattaactaggtttctaccttgggagccagccaccatttcagtacctttttttggtttgttttttcttttttaaagtttt

SEQ ID NO: 423198 - DNA, 9659 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacaggtaatgggtttttggttttgtagttgtcttttgcatctctctagatcttcatttcagtgtttaaaatggcttaagggaatcttttctaaaaacagagttctgtctgagtcctttccagtccttacgatctcatgatcagagttaacacagatcctgatttaccagataggatcgtaagagacagtttgtgtcctgagccacaaactgaagatacctatggcttccctccaggtagctctaagccaagtagatagtgatctgtaaactaactgtgtacacaggagtctagtttatttaaagaaactacttttaatgtgaataattcctctaatatagctgtaactctctgaatttaagtgtatatcttaaaataaactgtttttgaaggacaat

SEQ ID NO: 423199 - DNA, 5783 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaaccagaaatatttttagattgtgaaggagagctagtagatcttggtgaactatcaggagttggtgtcaacatatcattgtttcttgaaacatacagttctaaatcttcacaggccacgtctac

SEQ ID NO: 423200 - DNA, 1520 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaaggttaattttcagtcaaattaaatttttgtcaaatt

SEQ ID NO: 423201 - DNA, 182 bp, Homo sapiens
gctatttacattttttaatgcacttttaaaattcaaagatcacaggtttgtgccagcaacagaaagtgaaaaaaaatttcagaagagacttcaggaaattctcaaacagaatgatttctctgtgtaagtggttatttattatagatctcagaactaattttattcctttgttatgtagtctg

SEQ ID NO: 423202 - DNA, 808 bp, Homo sapiens
ctggtaaataaaaaaacaatacatgaaatcgtgtctggtttcttgtacctagaggctttgactattaaaaaaaaaaaacttaacgtgttttatgttgcttatcacatgacaaatgttaatttgcatgtcattccacatggttttccttaaactacatgatattctatttttagaaatagcaagctctctaaagtctcaaataactttcaatttttaataattttattatcccatcattgtaagtaacagattatttaggtaggttagcaggttacccagtagttacataattgaaagtgtaataacaatggtgaaacatactaggagatattttatctttacttgcatatcttttttgttttaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggtaatgataccctcagtaccttgccaggatagtcctgagattctgcacaggtctagaagacccaaatgaaaagacagtccatagacacagacacaaaattgtttctttacctgcgcacatgaagcctcactgaaagttagtgaatattccctcatacttcgtaagatgtgaagaggaaatcctcttttgggctttccttcagaaacttatgcaaagaaattgtgacacagtccttgattcatttgtttttcc

SEQ ID NO: 423203 - DNA, 339 bp, Homo sapiens
gactgtcttgaatgccaagctaaagtgtttatactttattcagtaaataaacaaaactggtagcgcaagaaaaggagtgagcaagtggtaacaacttaaagacaattcattttgctcccacgtgttatatcatgaatttgttgggcccaaagtcatatatagaattttttaaataattgatacttgattaaagaaagcacaaagacataaaaataaaacattcttggtggggggaaatggtttttaagaggcattttattaattttaccacaggtatatttgccctgtgttttacaaacaaaaaagaggtatgtgggttacatgtatgaaacactggat

SEQ ID NO: 423204 - DNA, 622 bp, Homo sapiens
tgaatgataaattcattgtttttattcatatgtggtaataatggaaaatttattttaagattaggagaggaaaggaatctgaaaagtttgtgtcatctccttgaaggacagaaggcttcatggggcattaaaataaaacaaaaaataccttctctccctaagattaatggtaccttccaaaggaaattaagtagtagtcatatacctgtgaggaaaagcatattgagactaaagatagaatgtacctgcacaatatagagggggcagggaagatagacatggacatttttgagactccaaaagggactttatctaggatatggagttaaatattttggtaattgctctttgaaacaaaacagttgttctaaaatatgttattatagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaat

SEQ ID NO: 423205 - DNA, 519 bp, Homo sapiens
ctaatactatggtcactctgttgttagcatgtttcaattcctgacagttggccattattatgttttatgcttccttcttaattatgtaaatctataatgtttgaggggttttaaacattttttttctttatgatagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggtaagtgatacaaatctgtagttttttcaaaagagactaaaatacagtgaggcacggtggcactcacctgtattcccagttactttggaagctaagatgtggtgcgggggtcttcagcccagagttgaatcctgcctggacaacatagtgagacctcatctcttttttaaaagaaa

SEQ ID NO: 423206 - DNA, 2514 bp, Homo sapiens
  misc_feature (253)..(253): n is a, c, g, or t
tcttgactactgggatatctgagctgatctgtgtgttagaaatattggatgtcttaaaagatttgtaacaagatataagtacataaggaaagtaataaaacaggagagcttacatagaaagcatcttaaagagtaaataggagaaagggagttttctttggcattagacaagagtcatagccaggaaagttactcttgataaaatttttgttataatgacttcctcattaccttactttatttttaatccccntagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggggatttattgcggcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcctgttctcactcatagatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423207 - DNA, 11111 bp, Homo sapiens
  misc_feature (317)..(317): n is a, c, g, or t
gcacgagactgcgctcgcctccctcctcacgcgggcgggattttcttgccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataacagtgtgacttcatcttttttataagcctgtattggttacatctttcttaccctacccttttctgagttttaatgaagtaaattatttaacatatttttatatcctgtttgatattgcaatttccttaccaaaacttcttcagggtt

SEQ ID NO: 423208 - DNA, 11292 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataac

SEQ ID NO: 423209 - DNA, 9928 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggtaatgataccctcagtaccttgccaggatagtcctgagattctgcacaggtctagaagacccaaatgaaaagacagtccatagacacagacacaaaattgtttctttacctgcgcacatgaagcctcactgaaagttagtgaatattccctcatacttcgtaagatgtgaagaggaaatcctcttttgggctttccttcagaaacttatgcaaagaa

SEQ ID NO: 423210 - DNA, 8781 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtgggtgatttatccaaaatgttgtttagaaataagatattcggtcaatataatgatttaatcattatagagtattagtaagatttactatatagcttatgcgtttgtcaattactgttatacttaagtagagttaaaatagtactttctaaaatgcaaaactacagaggtaatagactttaatgttttaagtgagtttttttttttttcttgtgtctaaggtagcaataactagaaaggtctatagctataataaaatattggggccaggtgcagtgctcacacttgtaatctcagcactttgggaggcccaggcaggggcatcccttgagcccaggagttccagaccagcctgagcaacatggcaaaaccctgtctctacaaataatagctaaaaaaaattagctggatgtggaggcgcatgcctgtggtcccagctacttggga

SEQ ID NO: 423211 - DNA, 1749 bp, Homo sapiens
  misc_feature (537)..(537): n is a, c, g, or t
tggttctcccagcatggtgtttgaactctgagaacggacaggctgcctcctcaagtgggtccctgacccccatgtagcctaactgggagacatctgcagtaggggccaacagacacctcatacaggtgggtgcccctctgggatgaagcttccagaagaaggatcaggcagcaatatttgctgttctgcaggctccgctggtgatacccaggcaaacagggtctggagtggacctccagcaaactccaacagtcctgcagctgacggaccttgtgaaaaaccgtctcagcggctgcccccgcctcctctgctggatgtgaaatggcggtcggcgagtggtttgcgtccgtgacatcatcatcatggcaacaagagctgcagcctgggaccgaggagcccgtgtgattcccggcggtggcggcagtggcggcagcaccagcaccgacgaaagcttcgagggcttctctccttgcggccccttgccgggtgctcctgaggaggcggcggcagcagcgcctacaccgccccgcccgccgntcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaaggttagttaatgttgtaaaggaaatgaaaattttacatatatcctagttgtgatcagaaatcagtggttaccataattaaattttaaccttttattgtattggatctttttaatctatacacttaacagaaacaaaccttgacattagtgtattacaaggaataaacgatttt

SEQ ID NO: 423212 - DNA, 2837 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcctgatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaaaaaattc

SEQ ID NO: 423213 - DNA, 574 bp, Homo sapiens
ctgtgtgacacagcaagatgctgtctccaaaaaaagaaaagaaaaatctcagtcccaattagcagaaaggctctagtgaaggaacagttctggtgagtagttcaggtactcttggaggaatctttaaggagcttccatttatttgatgtttcagatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatggataaaaacagcctaac

SEQ ID NO: 423214 - DNA, 883 bp, Homo sapiens
tataggatgtgctttagtccaacagacctaggctctaactctggttttaacacttgttctgtgagttagtcctgcagaacttcagtttccatctatagaattttccatttataaatcatagaaccttcctcctcacagaatttaagatgaaatgagatgttcatgaagtgcttaacactagagattagtgaggtctacctatatactaatacaatgatgacatagtaagctctgaaatagtatctatcacttatgaatggttattcaccatcccttatatccaacagagtttgagctccttgaggcaagaggctatagtttctgtaacatatgctccaggcatccggttaaatatgtccccgttcccttggccttatgtctgaccctttcacattgtaggtgctccatatgtttgagatccattttgtcctgctggccacatcccttgaatggattctgtgtaatttcaccagtgcttcttcagtctggcccctaacaccacctgcaggggcttcctcagagtccagttgtaacttgatggaacaagttacaacttcccaccttcgtggtaggtgggaagaaaagaatccctgaaatgcctgagggtgcatttttaaagacaggggaagagggtctcctataaaggaaaaggagttatccagctgcctcagcgcgaaaagcaaggaagaacagcagatccccacctctgtcgttccgatcattctggaagttcacaaacacagagtccacatttgtcttctcttccacgtactccagggttgcagtcaaactaggagccacagaaaaacagttaaaatgtttggccgctccctctccctctccctctccctctccctccacggtctccctctgatgccaccaa

SEQ ID NO: 423215 - DNA, 2818 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcctgatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaaaaaattc

SEQ ID NO: 423216 - DNA, 2667 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcaaaaaaaaaaaaaaaaaaaaaaacaaaaaaaaataacacagacaaaaaaaaaaaaaaaaaataaagaaaacaatagaaacaaaaaaaaaacaaagataacacagaacacaagaaacaaggaggcgatgggggagccgatccgaaagggcccagaggcggatcccttgacgggcaagggcaaggagacgcccctcgatgcattgggaatgtatacagaggagaaagaggcggggagaacctagaaacgaggagaggcgatagagtaaggacataaccgatagaagaggagcacagcccagagggcagcgagcacatagagagtaaaaagaaaaaaaaggagcaaagacagtgggggagaagaaagagaaacaaagacaaacgaacgacaaggaaatacaaacagacaagagtgaagaaaagagagagagcagaaccacccacaagaaagacaacgggggagagagagacacaaaaacaaataaagtgagagcgagaaaagaaaaaacaaaacaaaggaagagaaagagaataaaacacagaaacagacacacagaagagaaaaaaaaataca

SEQ ID NO: 423217 - DNA, 2384 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgctccatatgtttgagatccattttgtcctgctggccacatcccttgaatggattctgtgtaatttcaccagtgcttcttcagtctggcccctaacaccacctgcaggggcttcctcagagtccagttgtaacttgatggaacaagttacaacttcccaccttcgtggtaggtgggaagaaaagaatccctgaaatgcctgagggtgcatttttaaagacaggggaagagggtctcctataaaggaaaaggagttatccagctgcctcagcgcgaaaagcaaggaagaacagcagatccccacctctgtcgttccgatcattctggaagttcacaaacacagagtccacatttgtcttctcttccacgtactccagggttgcagtcaaactaggagccacagaaaaacagttaaaatgtttggccgctccctctccctctccctctccctctccctccacggtctccctctgatgccaccaa

SEQ ID NO: 423218 - DNA, 1844 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaagtatgtaacaaagagggagcccattaatcattgaagatagaaatactggcttagatattggagagattagaaggaatgccttctcagtctgagcagccagtataatatggctggggtcaggacagaagattcggtaagatattttgaagatgggatggaggtagaatccacaccaacagttgctggacagtttgaggatgcagatgttgatcactgaaaatgatttatgcaggtataagattctgctcctaattgtaggagagaacttggtgcctcttccactctgaagcaaagttgatgaaagtcttcttccttttcccaaaacccaacctgaactacttctttcttggagacagactatattgagacaagttgttaccagcaaaagatagatacatgacctttattaacaaaaatgaattaaccaagaggatatttgtagtttattatttaccccaaactttctgtgtctgggtaccctctgagtaggcctataattcctgccttcactgtatgcattttatgtaagctagcagacctatgtggtgagaatgcacaggagcttggaggtataaatagacagggtgggaaagagagagctcctttcgccatgttttaccagcccgctctgttataacctcttaggttatattctttaatttccaaccttttaggttagtttctgtaacagaacaaatgagtctgggataaagtcctcaaagtacttcaaatggtaattgttttgtttttgtaacggcttaacaaataacctaggttttctgttta

SEQ ID NO: 423219 - DNA, 2320 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatggataaaaacagcctaac

SEQ ID NO: 423220 - DNA, 2702 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcctgatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaaaaaattc

SEQ ID NO: 423221 - DNA, 2092 bp, Homo sapiens
gagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcctgatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaaaaaattc

SEQ ID NO: 423222 - DNA, 1623 bp, Homo sapiens
agtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcagggagtgacttcctaagccttccatttcaagcaataggaatttaacccctacaatcttttgccaggtgaccagtgggaagaggaagctttggatgagtttgatagactcactcattgtgctgactggaagcctctggtagccaagatctctagctatgtcttgctaggaagctcatatcgcgtatcacttcgtgtactaattctagcccgtatactcagagtttcttcccgt

SEQ ID NO: 423223 - DNA, 2391 bp, Homo sapiens
gctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaggtattgatgagcccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggattttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgcc

SEQ ID NO: 423224 - DNA, 2285 bp, Homo sapiens
cggtgttgcgtcgagttcgcgcagcgactggagcgggcagcgtctctcctggcgcgtagagcggtagtcgtccactgattcagggctcttgtgtacacgtggcgtgtgcttagcgccaaagggctctgtccgcacaggtggtgctgcagctcctcgtgttttgccgtctgccgtcgccgtcttgttaccgttgttcccggaggtcccgattggtttggtctcgcgcgctgcttctgccttggtgccttggtgcccccgcttcccccgacctgtttgttcggttgtgtcagttcagcccgccttgttgtacgtcctgtttgctgtttgtatttcgcgcgagtggggctgtcgtccacgcgttggcggtgcatcgtctcgccgttcagctggtcgtgtcgtgggccgtgggtgtacggggcggtcgcttcgtgcggggggggggggtcccgtcgcaaggcgcctgctgtggcggtgtgttgccatcggtgggtatggaggccgctcgatgctgtgtgtgccgctccgctatgtcgccgtatgcggagagttagtgcttgctggggtcgcgcgtcgctttggtggccggcgccgacacgccctgtggtgcattgagccgttatgtgggtccctgcgagggcgtgcggaccagtgcccctgggaaagttgtttgaagtgacaatgaaatcacagtggagtgctcaatcacttaacaatgttagatccattttgtttcaaaaaactgaatattaaagaaaatctgtcaacctagacgaccgatcaccaatactaaccctcctaagaactaaagccacagctgtgtctttcaatggattcgatacttttatcccctgactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaggtattgatgagcccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggattttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgcc

SEQ ID NO: 423225 - DNA, 3113 bp, Homo sapiens
gctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaggtattgatgagcccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggattttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttcttaaaaaaa

SEQ ID NO: 423226 - DNA, 2881 bp, Homo sapiens
gctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaggtattgatgagcccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggattttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttcttaaaaaaa

SEQ ID NO: 423227 - DNA, 1031 bp, Homo sapiens
cgacggtggccggcgccctagaggacctatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggattttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgcc

SEQ ID NO: 423228 - DNA, 1979 bp, Homo sapiens
gctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaggtattgatgagcccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgaaaagcatggtgcttatttgtccaatacagactcaaacttaaatgctgtcgacgcggccgcgaatttagtag

SEQ ID NO: 423229 - DNA, 588 bp, Homo sapiens
caaagatttgaattcagaaagtctagggttgggctcaggaatctgagagacagagagagttgagggaaactgagaagccaaccaaggctgacttccaagtctcttgactgttagagactataggaaaaggaaaaggaacatacctcggtgaatacaattgggaacttattccatttgaagtgcctaaggaatatctgagtggcaatcagctatgtgggcctatggttctaatactcaacacacagagagagagagtatggatggctgctgcctgttaatcttaggaccatctcacatcaggatgttccagtaaaaacctttctgataaagtgtgtctaataatgaatcaatacaaatgtgaaaatgatcttttattttggtcttgtggcttaattccaaataatttgcttcatgctccatcttcacaaaagggtttagtctaaatacttggagaattattcgtaacagctctagtttcaggctcctctgtttggcactggttggtggtccagttccttccatctgaccaagatgttacagcctactccaaaaactatgccagggagtgttctgagacataattcctat

SEQ ID NO: 423230 - DNA, 1281 bp, Homo sapiens
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423231 - DNA, 305 bp, Homo sapiens
ctagaggacccccgccttttacaactatctctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggccgccatttacaactatctcacacctttcttagcctggctcctctcaagggc

SEQ ID NO: 423232 - DNA, 1447 bp, Homo sapiens
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaaaaaaaaacaaaaaaaaaagaaaacttgcggggagctttattcgcgggggggggcaacaagggttctctggaacttggcacgttggccatagttgttatctgaacacgttttttggacacagggggaaattgggggtcacataaaggggggatacattaaaaagcag

SEQ ID NO: 423233 - DNA, 1386 bp, Homo sapiens
taggctaggtacgaggctgggtgttaatcggccgaggacagacctccctccgcgccccgcactgcgcgcgccctcccaggctcgggggtccccgcgtccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423234 - DNA, 1219 bp, Homo sapiens
gtgggtagaccgtggcttgtgggttgaccgtggcttgtgggttgaccgtggcttggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423235 - DNA, 1040 bp, Homo sapiens
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtgagcttctaaccctaactctatcccctgtgttgtccagagaccactccccagccaaccctagtgctgccctgggtacccttgccccactgagtccttccttgggcctcctccctgtcagtcctccctgggaccccttcccccaaccccagtccttccctttaccccatccttccccccagtcctcccctggaccccttctccccagtcccagtccttacctggaccctcttcattacccccaaagtcctccc

SEQ ID NO: 423236 - DNA, 597 bp, Homo sapiens
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423237 - DNA, 1117 bp, Homo sapiens
  misc_feature (13)..(13): n is a, c, g, or t
  misc_feature (15)..(15): n is a, c, g, or t
actaggctcaagngnttggtcaacaaaccccaggcggtttattaaacgagcatacatacgtcctagtcagctggtgcgatcggacgagcgcgcctcgtctcgagacctggaggcggggacctcgcgtgaggaccagacctccctccgcgccccgcactgcgcgcgccctcccaggctcgggggtccccgcgtccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggtgggtgtggaccagcagccttcactcttgtggggaatgggagctgaagaaggccctggagccaaatcatgaagagccagcaggcagctgagactacaggcgtgcgccaccacgcccggctaattttttttgtattaagtagagacggggtttcaccatgttggctaggctggtctcgaactcctgacctcaggtgatccacccgcctcggcctcccaaagtgctgggattacaggctgagccaccgtgccaggccatagatagtgtttcttaagagtgagtttgcttctgaggaagacaagtggggggtcgggggcatcccacctccctggccacctccagtggtgtgagttggttgcttgatgt

SEQ ID NO: 423238 - DNA, 1481 bp, Homo sapiens
  misc_feature (13)..(13): n is a, c, g, or t
  misc_feature (15)..(15): n is a, c, g, or t
actaggctcaagngnttggtcaacaaaccccaggcggtttattaaacgagcatacatacgtcctagtcagctggtgcgatcggacgagcgcgcctcgtctcgagacctggaggcggggacctcgcgtgaggaccagacctccctccgcgccccgcactgcgcgcgccctcccaggctcgggggtccccgcgtccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423239 - DNA, 1240 bp, Homo sapiens
acgtgactccgcggccgggccgggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423240 - DNA, 811 bp, Homo sapiens
agaggcttattagaagtgtgaaaacgtaggcttggattaaggcgacagcgatttctaggatagtcagtagaattagaattgtgaagatgataagtgtagagggaaggttaatggttgatattgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 423241 - DNA, 787 bp, Homo sapiens
  misc_feature (749)..(749): n is a, c, g, or t
  misc_feature (758)..(758): n is a, c, g, or t
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagagtacaataaancaccacaanacacgctacaaacgggagtaatgtcagtc

SEQ ID NO: 423242 - DNA, 917 bp, Homo sapiens
acgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggtgggtgtggaccagcagccttcactcttgtggggaatgggagctgaagaaggccctggagccaaatcatgaagagccagcaggcagctgagactacaggcgtgcgccaccacgcccggctaattttttttgtattaagtagagacggggtttcaccatgttggctaggctggtctcgaactcctgacctcaggtgatccacccgcctcggcctcccaaagtgctgggattacaggctgagccaccgtgccaggccatagatagtgtttcttaagagtgagtttgcttctgaggaagacaagtggggggtcgggggcatcccacctccctggccacctccagtggtgtgagttggttgcttgatgt

SEQ ID NO: 423243 - DNA, 230 bp, Homo sapiens
cagctttggaccttattgattgtctgcagttaccaccagaacaaaagaacatacatagattctgcctaggagaaaagaacaatgcttttctttatcatcagcaacgttttcaccatgacccatccccaaaaatactattgtcagaaactgtactctaaagtgattacacagttgcactgaaatagcgtttgtattataacgatcatacaaaagcaatataagaaacctgt

SEQ ID NO: 423244 - DNA, 2535 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423245 - DNA, 2481 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataacctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423246 - DNA, 2582 bp, Homo sapiens
tgggtttcccccaacttcattttttaagactatcagtgcatttctttaattgtagagcaattttgaaatgcagtcttcgctgggcttggtggcttacgcctgtcatcccagcactttgggaggccaaggtgggcggatcacctgagatcaggagttcgagaccagcctggccaacatggtgaaaccccatctctactaaaactacaaaaattagccacgtgtggtggtgcatgcctgtagtcccagctactcaggaggctgaggcaggagaattgcttgaacccgggaggcggaggttgcagtgagctgagatcgcgcccctgcactctagtctgagactcttgtatcaaaaaaaaaaaaaaaaagaagaaggaaaagaaatgtagtcttaagtttatttagtattataacaagcttttttaagatgcagaagtttttcaatctgtgatttcactacaaaggccctatatgtaagcatatatgtaaatagcttagaagcacaggtttgccagtatttaaagctattatcagctgtgggtatgcaatctgtcaagtttctaggtgttttctttttttttcccccctcatttattacttttaactgacacataatagttgtacatacttacggggtacagtgtgacattttgatagatgtatacaagcaggtgttttctatattatgaaaacatttggagaaaaatgattgacttattgtagtccttttctttcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423247 - DNA, 2493 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423248 - DNA, 1767 bp, Homo sapiens
aagctgcatacatcattgtatatgatctcacaactgatgagtccttggccatagccataactggggtctaggaacattcatgagtgcatgacctagttgttaagattgtttctacgcttaatcgagtcacggggccgaccgagcgtatagaagagctgcagatggccatgcagacgctacatccatttggcatcatgtaccaactaggtaagtctctatgcgaatgcgtacgactatacagaatatacagcactcgctccagtgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423249 - DNA, 1455 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423250 - DNA, 1545 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaataggtaagattaatatctctttttaaatgatcaatataagcaaaacaagtgtgaagcatatttggtttgactgtctcttttttaaaaaatttttgggggtgggtttgtgtgtatgtttatgtgtgtgtgtgagagagagagagagattataccacttttctaagtcccttccacaaaacaatattttgttggtaatattgttaaatttgaaagatgattacctattaggttgtaatactgtcagtttaggcagcttcttccaggtgagttaagccttaacctcttaacctgatagttcagacagacagattttgcaaaggtttcgctgggaaatttggataaatattttttttattagattatactttttaaaaatcaaattattggtaaatataactcagaagaacatgacacataagtatacagattgacaaattattttaatgtaaacattataaggaagatgatttcaaagcatagaggcgtaaggaa

SEQ ID NO: 423251 - DNA, 2327 bp, Homo sapiens
cgtcgccgggcgattcacacgggactgtgcggggctcgtgccatggtgctgccctgtcgggctccgtctccgactctcgccgctcccccttcctctttcctttctcctcctccgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaaaaaaaaaaat

SEQ ID NO: 423252 - DNA, 2441 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggacttgttgattattgagggcctaggtgg

SEQ ID NO: 423253 - DNA, 2008 bp, Homo sapiens
  misc_feature (1976)..(1976): n is a, c, g, or t
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgttcggaatgggtgcatggggatcntctagagtcgggccttcaggaaggggttcaaa

SEQ ID NO: 423254 - DNA, 1180 bp, Homo sapiens
  misc_feature (1179)..(1179): n is a, c, g, or t
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccagtgaaatcccccagtgaatccacgtttgcng

SEQ ID NO: 423255 - DNA, 1103 bp, Homo sapiens
ggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgcgcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaatgtccaaagaatgaactgcttggcagtttggaccgacct

SEQ ID NO: 423256 - DNA, 2395 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 423257 - DNA, 2534 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaaaaaaaaaaaaaaaaaaaaaaaaaaaaaaaaaaaaaaaaactaaagggggggcccggaacccaataccccattagcgagaacgaaaaaaaatactcgggggggggcccggtacccatttgacctttaaagacgctgatta

SEQ ID NO: 423258 - DNA, 2338 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgtcccgacactttgggaggcggaggtgggtggatcacctgaggtcaggagttcgagaccagcctgaccaacatagcaaaccccgtgtctactaaaaatacaaaaattagccaggcgtggtggtaggcatctgtaatcccggctactcgggaggctgaggcaggagaatcacttgaacccggggggcggaggttgcagtgagccaagatcgtgccattgcactccagcctgggcaacaagagcaaaactctgtctcaaacacaaaccaaaaaaaaagtagactaatttagagttt

SEQ ID NO: 423259 - DNA, 2554 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtagctggaatatcaagtgcatgccagtgacccggctcctgatactgtcatatgaagaaagcattggctcttgaagtcagacccatcatcatttactggctgtgtgactccaagcacacgctgcctctctgggactgccgcctcatctctggaatgggagtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 423260 - DNA, 2098 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 423261 - DNA, 966 bp, Homo sapiens
taggtggaaatatcaactatctcagtaattaataaaaccagtatttaaaaaatagagaggggtagtgtcaatcacagtggtggactaaagacctttacaatttttctcctccataaaatcaatgaggaaactggcaaaaatgatcagaattcacttttctaggactctggaaatgaaccagaggtttgcagcaatctggagcataactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactgagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 423262 - DNA, 1188 bp, Homo sapiens
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtattaaaaaaaaaaaaaaaaggccaggcacggtggctcacgcctgaaatcccagcaatttgggaggccaaggcaggtggatcacctgaggtcaggagttcaagaccagcctggctaacatggtgaaaccccatctctactaaaatacaaaaattagctgggcatgatggcaggtgcctgtaatcccagctattcgggaggctgagacaggagaatcgcatgaacctgggaggcacaggttgcagtgagctgagatcgtgccatagcactccagcctgggcagctgagcgagactccgtctcaaaaaaaaaaacca

SEQ ID NO: 423263 - DNA, 816 bp, Homo sapiens
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgatttt

SEQ ID NO: 423264 - DNA, 687 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgatttt

SEQ ID NO: 423265 - DNA, 587 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgatttt

SEQ ID NO: 423266 - DNA, 808 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatgtaatgtgcactttcctatttctgttgaccgtgtcataataacatatgtgttcctcagtgttgggttggaggctaaattcctgcaagccagtggttagtaataaacccaaataatagtgaagagagctctggacagagagttgaggtttaaccctgcctcttactaagacagtttacatatgagtaaacataaatttagctaaattaagcgaggttaattttatctgttcttaccatatagggtcaggaagacccctcaagtatttttgcttgagaagctgacagaaatctaaatgataaaacattaggcgtggatattttgtgtgctagcctgcatatcattctctcttcccgtaaactccttgagggtgggatccatgtctttttcatataccaggaacttgcttgtacctataacagtccttaacacagcctca

SEQ ID NO: 423267 - DNA, 791 bp, Homo sapiens
atgagcgatgtgacctagcgtatgggagagaagtggacgaatcaaaagtatatttagcaggtgaaaattcaggactttacggattagatataggatttgagtgacaggttgggtctcaacgatgattccaagtttctgacctgatagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgtttcactcttgttgcccaggctggagtgcaatggcgcgatcttggctcacggcaacctctgcctcccgggttcaagcaattgtcctgcctcagcctcctgagttgctgggattacagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataactctcttcacaagaagaaagtatcggggagtgatgcttgaggggatcctcgtagagacg

SEQ ID NO: 423268 - DNA, 329 bp, Homo sapiens
ggctgaccctgaggatcccctcttcagctgtgttgaggtttaaccctgcctcttactaagacagtttacatatgagtaaacataaatttagctaaattaagcgaggttaattttatctgttcttaccatatagggtcaggaagacccctcaagtatttttgcttgagaagctgacagaaatctaaatgataaaacattaggcgtggatattttgtgtgctagcctgcatatcattctctcttcccgtaaactccttgagggtgggatccatgtctttttcatataccaggaacttgcttgtacctataacagtccttaacacagcctca

SEQ ID NO: 423269 - DNA, 490 bp, Homo sapiens
agtgccaatggatgttggaaaggaatcattaaagtgaaaaagtaggcagtgagaactgttaggacatgaaaaataagagcctgaccaaggaagaaggcagatcaggaaatgtttcagacgtaggaaacaatggttaatgatcttgtgttttttttttcattttttttctcttagatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgatttt

SEQ ID NO: 423270 - DNA, 650 bp, Homo sapiens
agtgccaatggatgttggaaaggaatcattaaagtgaaaaagtaggcagtgagaactgttaggacatgaaaaataagagcctgaccaaggaagaaggcagatcaggaaatgtttcagacgtaggaaacaatggttaatgatcttgtgttttttttttcattttttttctcttagatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaaggtttgccagtccatatttttagaaagagtgtgatagatgagcaataatgctgatgccgtttgcctattgatcaccagagctccttgttttttgaacttttgagaaagttaatctaattttaaaaattacttaaaaattacagatacaaagaactgggaggtgtgatggtttatgtaaaatataattacaaactcagctgacataaccattctccacattaagaaagagaatacctttaaatatcaaacttacatagtatatttaaaatgtaaaataaatttagtatgcttttaaaatgg

SEQ ID NO: 423271 - DNA, 263 bp, Homo sapiens
atgagcgatgtgacctagcgtatgggagagaagtggacgaatcaaaagtatatttagcaggtgaaaattcaggactttacggattagatataggatttgagtgacaggttgggtctcaacgatgattccaagtttctgacctgagtgagtaaattacgctaaacaagaacaaactattttgaagttttctaagggttcttccccccactcagtgttaaaaagcacgtttttttcctttcttattatgtgtactcatgttttgt

SEQ ID NO: 423272 - DNA, 1176 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgtttcactcttgttgcccaggctggagtgcaatggcgcgatcttggctcacggcaacctctgcctcccgggttcaagcaattgtcctgcctcagcctcctgagttgctgggattacagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtattaaaaaaaaaaaaaaaaggccaggcacggtggctcacgcctgaaatcccagcaatttgggaggccaaggcaggtggatcacctgaggtcaggagttcaagaccagcctggctaacatggtgaaaccccatctctactaaaatacaaaaattagctgggcatgatggcaggtgcctgtaatcccagctattcgggaggctgagacaggagaatcgcatgaacctgggaggcacaggttgcagtgagctgagatcgtgccatagcactccagcctgggcagctgagcgagactccgtctcaaaaaaaaaaacca

SEQ ID NO: 423273 - DNA, 925 bp, Homo sapiens
  misc_feature (825)..(825): n is a, c, g, or t
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttaaaaagaanaaaaagacaaaaaaacatttgtgggcgcctcgcctggaaagatttaaaaaaatctggggggcggagacacgaagagaagagaacgggcatagaggggtcc

SEQ ID NO: 423274 - DNA, 804 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgtttcactcttgttgcccaggctggagtgcaatggcgcgatcttggctcacggcaacctctgcctcccgggttcaagcaattgtcctgcctcagcctcctgagttgctgggattacagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgatttt

SEQ ID NO: 423275 - DNA, 744 bp, Homo sapiens
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataactctcttcacaagaagaaagtatcggggagtgatgcttgaggggatcctcgtagagacg

SEQ ID NO: 423276 - DNA, 150 bp, Homo sapiens
cccccactcagtgttaaaaagcacgtttttttcctttcttattatgtgtactcatgttttgtgtgcttactgtagaaaattcagaacatacataacaaaatattttcttttatataaaggacaataaaaatcacctcataacctcactac

SEQ ID NO: 423277 - DNA, 512 bp, Homo sapiens
tgataggtgacagagatgggattcaaacccagacattctttgcctcaatttcctcatcaattacatactactactactgctactactactaataatagtgtcaatttcatagggtagttttgaggattaaagaaaatattacaagtaaaatgtttgcaatatgatcatgcccataatattagccctcaattaatgttatttaaaaaaattttactatttgcataagttccttgcagctttaaaattctgtgatttcctgactacccaggcccttgggataatagttgttttttgttttttttttttttgagacagtttcactcttgttgcccaggctggagtgcaatggcgcgatcttggctcacggcaacctctgcctcccgggttcaagcaattgtcctgcctcagcctcctgagttgctgggattacaggtgcgtgccaccacgcctgactaatttttgtatttttagtagagagggtttcgccgtgttggccaggctggtcttgaacc

SEQ ID NO: 423278 - DNA, 1059 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtattaaaaaaaaaaaaaaaaggccaggcacggtggctcacgcctgaaatcccagcaatttgggaggccaaggcaggtggatcacctgaggtcaggagttcaagaccagcctggctaacatggtgaaaccccatctctactaaaatacaaaaattagctgggcatgatggcaggtgcctgtaatcccagctattcgggaggctgagacaggagaatcgcatgaacctgggaggcacaggttgcagtgagctgagatcgtgccatagcactccagcctgggcagctgagcgagactccgtctcaaaaaaaaaaacca

SEQ ID NO: 423279 - DNA, 796 bp, Homo sapiens
  misc_feature (696)..(696): n is a, c, g, or t
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttaaaaagaanaaaaagacaaaaaaacatttgtgggcgcctcgcctggaaagatttaaaaaaatctggggggcggagacacgaagagaagagaacgggcatagaggggtcc

SEQ ID NO: 423280 - DNA, 847 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaaggtttgccagtccatatttttagaaagagtgtgatagatgagcaataatgctgatgccgtttgcctattgatcaccagagctccttgttttttgaacttttgagaaagttaatctaattttaaaaattacttaaaaattacagatacaaagaactgggaggtgtgatggtttatgtaaaatataattacaaactcagctgacataaccattctccacattaagaaagagaatacctttaaatatcaaacttacatagtatatttaaaatgtaaaataaatttagtatgcttttaaaatgg

SEQ ID NO: 423281 - DNA, 726 bp, Homo sapiens
aagacggggattggccatcgcttccggaagttgtgagctttgtttcggagcgggagctcttccgagacgcactgggggccggatgggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttaaaaaaaaaaagctgaaaaatttggggggggttgggctctgaaaaagtttaaaacctggggggggcggggcccagggttgggacctgggcgggggtcaggaa

SEQ ID NO: 423282 - DNA, 959 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtattaaaaaaaaaaaaaaaaggccaggcacggtggctcacgcctgaaatcccagcaatttgggaggccaaggcaggtggatcacctgaggtcaggagttcaagaccagcctggctaacatggtgaaaccccatctctactaaaatacaaaaattagctgggcatgatggcaggtgcctgtaatcccagctattcgggaggctgagacaggagaatcgcatgaacctgggaggcacaggttgcagtgagctgagatcgtgccatagcactccagcctgggcagctgagcgagactccgtctcaaaaaaaaaaacca

SEQ ID NO: 423283 - DNA, 918 bp, Homo sapiens
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttaaaaaaaaaaagctgaaaaatttggggggggttgggctctgaaaaagtttaaaacctggggggggcggggcccagggttgggacctgggcgggggtcaggaa

SEQ ID NO: 423284 - DNA, 937 bp, Homo sapiens
tgcgcatcagcccggacagggtctacatcaactattacgacatgaacgcggcaatgtgggctggaacaactccaccttcgcctaagagccgcagggacccacgctgtctgcgctggctccacccgggaacccgccgcacgctgtgttctaggcccgcccaccccaaccttctggtggggagaaataaacgccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatgtaatgtgcactttcctatttctgttgaccgtgtcataataacatatgtgttcctcagtgttgggttggaggctaaattcctgcaagccagtggttagtaataaacccaaataatagtgaagagagctctggacagagagttgaggtttaaccctgcctcttactaagacagtttacatatgagtaaacataaatttagctaaattaagcgaggttaattttatctgttcttaccatatagggtcaggaagacccctcaagtatttttgcttgagaagctgacagaaatctaaatgataaaacattaggcgtggatattttgtgtgctagcctgcatatcattctctcttcccgtaaactccttgagggtgggatccatgtctttttcatataccaggaacttgcttgtacctataacagtccttaacacagcctca

SEQ ID NO: 423285 - DNA, 1008 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatgggcccttgggcggattccgtaaaccgtacccgttgagaagcagattacgaagtggacctgaatgggcacaggtgaatcaacaagcccggaacagcgcacacggtacggagggcaagaagcagccggtacgagcgaatggctctcaccgggaacgcgaggacggaagagagacaaagtgaaagcacacagaacgaacagcgacacggaaggcagcgaaaattgacactacggaaaggaccgacatgcggcacaaggacgc

SEQ ID NO: 423286 - DNA, 1283 bp, Homo sapiens
  misc_feature (896)..(896): n is a, c, g, or t
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaaggtatgggaggtttgctgcagcttgggccctcaggatgcataatccctgtgttctctgatacagaacaccacactactgctggggaaataactggctcacattgctcaactgtacttttacttgttaatgttcattctgggttattacccattgaaaaaaaaatccttgtagccataaaaaatgatgagttcatgtcctttgtagggacatggatgaagctggaaaccatcatcctcagcaaactgtcgcaaggacaaaaaaccaaacaccgcatgttctcactcataggtgggaattgaacaacgagaacacatggacacaggaaggggaacatcacacaccggggactgttgtggggtggggggagggggaggaatagcattaggagatatacctaatgtaaatgacgagttaatgggtgcagcacaccaacatggcacatgtatacatatgtaacaaacctgcacgttgtgcacatgtaccctaaaacttaaagtataataataataaaatttaaaaaaaaaagaaaaaaaaatcctaaaatgtttctttaaaaaaaaatcccttgccaggcanggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactg

SEQ ID NO: 423287 - DNA, 1682 bp, Homo sapiens
  misc_feature (1295)..(1295): n is a, c, g, or t
ttttaaatgcagctgactaatttaggcaaatgtcttaacagttgattggtatgaacttatccattagaaatcaagcctcaagtggttatttgtagatgcaatgcttttgcttataatagttagaaaataatgctcatattcttttgggtaggtgatgactttaaaagtacagtttaaaggatttataagacacaaaatgccatttaacaaatatgtaaaattgtatacattctttcaacaaataattattgagtgccacatatgtgccatgcaatttgctatagtgatggacaagacagacatgatctctgccctaaaaaagctcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaaggtatgggaggtttgctgcagcttgggccctcaggatgcataatccctgtgttctctgatacagaacaccacactactgctggggaaataactggctcacattgctcaactgtacttttacttgttaatgttcattctgggttattacccattgaaaaaaaaatccttgtagccataaaaaatgatgagttcatgtcctttgtagggacatggatgaagctggaaaccatcatcctcagcaaactgtcgcaaggacaaaaaaccaaacaccgcatgttctcactcataggtgggaattgaacaacgagaacacatggacacaggaaggggaacatcacacaccggggactgttgtggggtggggggagggggaggaatagcattaggagatatacctaatgtaaatgacgagttaatgggtgcagcacaccaacatggcacatgtatacatatgtaacaaacctgcacgttgtgcacatgtaccctaaaacttaaagtataataataataaaatttaaaaaaaaaagaaaaaaaaatcctaaaatgtttctttaaaaaaaaatcccttgccaggcanggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactg

SEQ ID NO: 423288 - DNA, 837 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcaggtgaggaaaattatgattggaacataacaggacacagattaggttcctctgtgttcatgtttatccccagattgtctatctctttctgcccagaagttatgtaaccttgttacaaatagacctctaatgattaaggtccaggagtaaatgccaatttcacatataatgtagacagattatctgatgggcatctatcagatacaaagtctgcccctttttcatgtcctttttgtctaaatatagtcattatcatcatcatcatcatcatcaaatcatttcatcaccatcagaaatgcttatacattatcctgatgtataccaaagctactgtttggaaagaaactaaaataaaagtccaggtcacttaaccatacagggctgatgttagatgaaagcaagcatcgataccaaatgcaattttacataatattagctgtcaacaaaatatatttggacagccgcatggtaattttacacattatgtgtaaacaaagtattggtggcatcacatggtaaaaactcagtaatttcacctcagaaattcttcttcacatcagaaatgtagtttgtgcattgaggctatctgattgatgtttatgcctctctgcttgggatatattcatgagaataaataatagaaacctct

SEQ ID NO: 423289 - DNA, 1504 bp, Homo sapiens
ctcggccgattcggcacgaggtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423290 - DNA, 1492 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423291 - DNA, 3065 bp, Homo sapiens
attcggcacaggattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423292 - DNA, 3011 bp, Homo sapiens
attcggcacaggattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcatcaaggcccaagacccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423293 - DNA, 1797 bp, Homo sapiens
tatagtaccgtggcgaatttgggaacagaatccagttaatgacatcttggaggaacttagaaacaggaagtgactcaggattgggaagcaccagaaatagagctgctgacatgacatggtgacaagcattctttgtcaattgactttttctcccgccccctggatcctaaggaaacggcacagcatttccttgccctgcccttgacgtgctatgcctactctaagctagataggggcttctgaaagaaaaacctaaggaagccccctgctcatgcctggaggaaagaactgccgttgttcttcgacgattcgtcgaagaacaacggcaaccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423294 - DNA, 1750 bp, Homo sapiens
tcctttaaacgtacttttaaactcatcacctaccaaaagaatatgagcattattttctaactattataagcaaaagcatgcatctacaaataaccacttgaggctgatttctaatggataagttcataccaatcaactgttaaggacatttgcctaaattagtcagctgcatttaaaaaaactcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423295 - DNA, 1891 bp, Homo sapiens
ttttaaatgcagctgactaatttaggcaaatgtcttaacagttgattggtatgaacttatccattagaaatcaagcctcaagtggttatttgtagatgcaatgcttttgcttataatagttagaaaataatgctcatattcttttgggtaggtgatgactttaaaagtacagtttaaaggatttataagacacaaaatgccatttaacaaatatgtaaaattgtatacattctttcaacaaataattattgagtgccacatatgtgccatgcaatttgctatagtgatggacaagacagacatgatctctgccctaaaaaagctcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423296 - DNA, 1390 bp, Homo sapiens
tgggtcggcgctcagtatggccggagtcgctgtcgacttgcgctctccgtgtcggttacccattgctcgtggcacttgcgagaggtcaggatcttctagagtcaatgtgacaacatgacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423297 - DNA, 1748 bp, Homo sapiens
tatagtaccgtggcgaatttgggaacagaatccagttaatgacatcttggaggaacttagaaacaggaagtgactcaggattgggaagcaccagaaatagagctgctgacatgacatggtgacaagcattctttgtcaattgactttttctcccgccccctggatcctaaggaaacggcacagcatttccttgccctgcccttgacgtgctatgcctactctaagctagataggggcttctgaaagaaaaacctaaggaagccccctgctcatgcctggaggaaagaactgccgttgttcttcgacgattcgtcgaagaacaacggcaaccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423298 - DNA, 1444 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaagcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423299 - DNA, 2773 bp, Homo sapiens
attcggcacaggattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423300 - DNA, 1029 bp, Homo sapiens
cttcacaggattcctaggaatcctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423301 - DNA, 1004 bp, Homo sapiens
  misc_feature (4)..(4): n is a, c, g, or t
  misc_feature (11)..(11): n is a, c, g, or t
gctntctatgnctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423302 - DNA, 1200 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423303 - DNA, 872 bp, Homo sapiens
ggtcggtacccagatcttctcccatcaggactgagcgtggtattccttcgttactacgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423304 - DNA, 1581 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcggatggagtctgctggcatccatgaaaccacctacaacagcatcatgaaggatggctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423305 - DNA, 1010 bp, Homo sapiens
  misc_feature (7)..(7): n is a, c, g, or t
  misc_feature (62)..(62): n is a, c, g, or t
  misc_feature (105)..(105): n is a, c, g, or t
  misc_feature (128)..(128): n is a, c, g, or t
  misc_feature (136)..(136): n is a, c, g, or t
  misc_feature (153)..(153): n is a, c, g, or t
  misc_feature (173)..(173): n is a, c, g, or t
  misc_feature (177)..(177): n is a, c, g, or t
  misc_feature (188)..(188): n is a, c, g, or t
  misc_feature (194)..(194): n is a, c, g, or t
  misc_feature (199)..(199): n is a, c, g, or t
  misc_feature (202)..(202): n is a, c, g, or t
  misc_feature (232)..(232): n is a, c, g, or t
tcacccnaacaaatgtcccccaatcttatggagggcttatgcctttgccccccaatgcccantcaatgcagtcttgggatcgtggcttgggccggaggatcgtcnacttgacttacactcaatcgaangatctctngacatggagctgtggcntaattcacttctgttaactnactngcttgaagcgntgaagnattgntcncgggcacaatcaacagggagaagaacctgntgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423306 - DNA, 1157 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctaccgtgaagtacccgataaacatgcacgcgacatcgccagggatcctctaga

SEQ ID NO: 423307 - DNA, 1120 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagccaggtcacaatgacaacaaagaagctgctaaaaatctagcagcatgccttaggctgagatgccataa

SEQ ID NO: 423308 - DNA, 1257 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423309 - DNA, 817 bp, Homo sapiens
tttttttttttaccagtagcctatttcagatttattaaaaaacacataggtaacgagtcagagctttggctaggaatgatttggaaaagaactgaaggcataattccacaggacattcacagttgtgtgctagagactgagaggagcaggaaagtcttttagaagcatttgcggtggacaatggaaggcccggctggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423310 - DNA, 880 bp, Homo sapiens
accacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423311 - DNA, 681 bp, Homo sapiens
acttcaggatgctgttttaggtggtttcctggatcctagcagactccatccgtatgaggatggctggatacagggtatctgggcagcggaaacgttcatttccgatggtgatcacttgcccatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423312 - DNA, 2588 bp, Homo sapiens
attcggcacaggattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423313 - DNA, 1235 bp, Homo sapiens
ttttaaatgcagctgactaatttaggcaaatgtcttaacagttgattggtatgaacttatccattagaaatcaagcctcaagtggttatttgtagatgcaatgcttttgcttataatagttagaaaataatgctcatattcttttgggtaggtgatgactttaaaagtacagtttaaaggatttataagacacaaaatgccatttaacaaatatgtaaaattgtatacattctttcaacaaataattattgagtgccacatatgtgccatgcaatttgctatagtgatggacaagacagacatgatctctgccctaaaaaagctcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaagcactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423314 - DNA, 1017 bp, Homo sapiens
  misc_feature (1)..(1): n is a, c, g, or t
  misc_feature (11)..(11): n is a, c, g, or t
  misc_feature (16)..(16): n is a, c, g, or t
nttcatgcggnactgnctctcttaatctaccaccgctacacaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423315 - DNA, 1586 bp, Homo sapiens
aagagctcacttatcaccaaggagatgtcctaagccattcatgagagatccacccacgtgatccaaacacctcctaccaggccccacctccaacacgggggattacatctcaacatgagatttggaggagatatccaaactatactaaattctttacaacttttctgaaaatctaaaattgttccaaaataaaaaggttatttttaaaaccaaaccaaaacataaaaccacctgggagaacccaggtttgaatatcagatctgacactgatataaccggtgttacctgggccagttacttaaactttctcagcctctgtttcctcatatgtaatatgggagtaatttaagacttattcttcaagatgtttatgagaatcaaatgagataatacatgtaaaatgcttagcatagtgcctggcatataattacatgctcagtaaatatcagtactttgtattaagaagtaaatgctcagaagataaagattaaactggttagccagttttcactgttctctgtgcctaaaccattcatttatttaagaaacatgagcatgccttgcaggttaggcctgtgcactgggaaaggccaaccagtgcagcttaagaggcacctattgcaagggaatgtccccagcaggggaccctgagttccccaatgttaaacagagcatctgggtgaaaagtggtagttcacttcaccacgtggaaacacatttgtatactaagtcctagcacaattaaaacttctcctttgaataggctagggtttgtttctacagaaagtgtatcgtgttgaattctgaggcagagttcatggaaatcagaggcattgccagggttcttaagtgggggccatggctggatttggagccaactttcagtttgctcaataatgtggtcgaagagttacaggtgagaaaaacgaatgtgcttactgaagaatttctaaatccatggctccctctggcggtcctgccaagaacatgacacaattaggacacaattggcatctaacagacaagcctgtgtccctgctgaacaagaaactaggccatggtagaacatccaggctctgtcctaccgcactaacgactgcactaatgatgacattaatgaccattctttttcatcttgactgacagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423316 - DNA, 2410 bp, Homo sapiens
attcggcacaggattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcaggtgaggaaaattatgattggaacataacaggacacagattaggttcctctgtgttcatgtttatccccagattgtctatctctttctgcccagaagttatgtaaccttgttacaaatagacctctaatgattaaggtccaggagtaaatgccaatttcacatataatgtagacagattatctgatgggcatctatcagatacaaagtctgcccctttttcatgtcctttttgtctaaatatagtcattatcatcatcatcatcatcatcaaatcatttcatcaccatcagaaatgcttatacattatcctgatgtataccaaagctactgtttggaaagaaactaaaataaaagtccaggtcacttaaccatacagggctgatgttagatgaaagcaagcatcgataccaaatgcaattttacataatattagctgtcaacaaaatatatttggacagccgcatggtaattttacacattatgtgtaaacaaagtattggtggcatcacatggtaaaaactcagtaatttcacctcagaaattcttcttcacatcagaaatgtagtttgtgcattgaggctatctgattgatgtttatgcctctctgcttgggatatattcatgagaataaataatagaaacctct

SEQ ID NO: 423317 - DNA, 773 bp, Homo sapiens
atcgggatggagtctgctggcatccatgaaaccacctacaacagcatcatgaagtgtgatattgacatcaggaaggacctctatgctaacaatgtcctatcagggggcaccactatgtaccctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423318 - DNA, 550 bp, Homo sapiens
cagtgtgttgctcagtaacttccaggaccatcctcactatccaaggagatgatgggatgaagttttgcaaatggcaaggcctggctctaatgcacagagcaaagcacatctttctttgctgtgtgaagttgcaaaatgattacactatttccttgaggagaacagttatagacacccagtgttatgcattagtcagtgttgtataattgatctttttttaatccccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423319 - DNA, 434 bp, Homo sapiens
  misc_feature (3)..(3): n is a, c, g, or t
  misc_feature (15)..(16): n is a, c, g, or t
  misc_feature (115)..(115): n is a, c, g, or t
  misc_feature (117)..(122): n is a, c, g, or t
ctnaaacccagccannttatatctgtttaggtaagtaacaggagtgaggtggtgtatttacaagttggcttgtccagatatactataacttagtgtctgtatttaatattgacancnnnnnnatatatataattctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaagaatatataataaaaaagttttgcccatagtgagccgattacattgtcgacggcgccgcaatttagtagtagagtagtaatcacccggaatcccgacggtacctgaagcgtacaagttcccttagtggtcgtttagactggg

SEQ ID NO: 423320 - DNA, 168 bp, Homo sapiens
gctatattagataagggtcagaggatagcactaggacacagaggagggcccccaaacccagccttggaggtgggagttgtcaggtaagtgccacaaatgcccaattacagctgaggctgcttcctccctgttttctatagaatcctgtgaagcagctccagctatgtg

SEQ ID NO: 423321 - DNA, 399 bp, Homo sapiens
aaacctgtccagagggcaagatgccccgagccccggggaaggatgaggacacacctgatgtccaggtgtatgggggtgggggcggggactcacacacctgggagacataactgactgtggaagggtcaccgatatcctgggagagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataaggtaggatttaagcacctctcccttccccaaaactccttatgggtacctttttcccttttcctcgtgatcgtaatatcccatctgtggctgagagtaggagcct

SEQ ID NO: 423322 - DNA, 2600 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423323 - DNA, 2640 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423324 - DNA, 3089 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaaggtgccaaccccacccccttgaccctagcccacctttccatctgtaacactaaccttcccctcagaccctccccattattgaatgaggaaatgcagcctagctggggagtagagtgttcaccccctcaacccctgggcctttccagatcaccctccctccaattcctggccctttcctgttggaggatttggctgctggtcccaggaacataactgggaaaaatcaccccctgagctggggtacaaaaaccctaggcccacaaatccagtgaggtttcttccatcatactgacccttctcctttgactccctgggtagagttcagcccctaccccaaaagcaccatcagagcagagtccttgtgcccctggtctgtgcctgggctcaggctcatagaccctcaagaagggcgcctgagtccagccttagctgaccctgctggacccccagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423325 - DNA, 1833 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaataattattaaaaaaatcctcttagtgggggacccggttcccaatttgcctattattgt

SEQ ID NO: 423326 - DNA, 2499 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423327 - DNA, 2714 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcagcccacagggagaaccccttcagggtgggcccagccctacccccagcagcactcacctgtggaggcagcctaagggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423328 - DNA, 2836 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacaggaggccatatgtatatcaggatttggttctcaccgcgcaaagtccgagttcctcctagtaagcaggagcatccagttgtctctagcatctccttcagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423329 - DNA, 3353 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacaggtatgaatgttcagaaacaggaatcttgggtggaggaggggacaggaatggtttggggaagcataggatatgtctaggaaagcttgaattatgtctggagatcttgggaacttctgcttgtaggaacctcatggactctcctcagcccaaaagcaactcccagcgttgtccatccatttcccttttgccacttagcccctgaaatggctcatttgtcctttccctgccaccacctgagtcaagttaagacctgcttcacaggaatgccccccctctacagcttgaggctgagttggaactttgtgaagcttctcagaatttttagattctaaagtttagaggaacaaacagccctgaatctcacactaagattccacatgggaatgcaaccaggtttcttgttatcatgacccaccatccttgactcctgctgcccccaaactcagtgtattttcttctgtttcctctgcccctgtacaccaacaactccctgcaaacccctcctctaacccccaaggaggccatatgtatatcaggatttggttctcaccgcgcaaagtccgagttcctcctagtaagcaggagcatccagttgtctctagcatctccttcagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423330 - DNA, 3276 bp, Homo sapiens
agaggacgtcatttccgccgagtccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacaggtatgaatgttcagaaacaggaatcttgggtggaggaggggacaggaatggtttggggaagcataggatatgtctaggaaagcttgaattatgtctggagatcttgggaacttctgcttgtaggaacctcatggactctcctcagcccaaaagcaactcccagcgttgtccatccatttcccttttgccacttagcccctgaaatggctcatttgtcctttccctgccaccacctgagtcaagttaagacctgcttcacaggaatgccccccctctacagcttgaggctgagttggaactttgtgaagcttctcagaatttttagattctaaagtttagaggaacaaacagccctgaatctcacactaagattccacatgggaatgcaaccaggtttcttgttatcatgacccaccatccttgactcctgctgcccccaaactcagtgtattttcttctgtttcctctgcccctgtacaccaacaactccctgcaaacccctcctctaacccccaaggaggccatatgtatatcaggatttggttctcaccgcgcaaagtccgagttcctcctagtaagcaggagcatccagttgtctctagcatctccttcagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423331 - DNA, 2575 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423332 - DNA, 2552 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423333 - DNA, 1009 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatgcacacagcgtttaccactctgcgaccgtatgaacgcccccctgccatagcgatgcatgcccgcacgacactctagaagatgactccatggtttccgctacgcaccgtccatcctcgatccaaaccttcgggtgaacggtaccgagctcgatcgaca

SEQ ID NO: 423334 - DNA, 1728 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacaggtatgaatgttcagaaacaggaatcttgggtggaggaggggacaggaatggtttggggaagcataggatatgtctaggaaagcttgaattatgtctggagatcttgggaacttctgcttgtaggaacctcatggactctcctcagcccaaaagcaactcccagcgttgtccatccatttcccttttgccacttagcccctgaaatggctcatttgtcctttccctgccaccacctgagtcaagttaagacctgcttcacaggaatgccccccctctacagcttgaggctgagttggaactttgtgaagcttctcagaatttttagattctaaagtttagaggaacaaacagccctgaatctcacactaagattccacatggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 423335 - DNA, 813 bp, Homo sapiens
  misc_feature (22)..(22): n is a, c, g, or t
ggtgccttttgtcaagtttgtncatgtagcaggctggtccggtccgggattcccgggtttccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacaggaggccatatgtatatcaggatttggttctcaccgcgcaaagtccgagttcctcctagtaagcaggagcatccagttgtctctagcatctccttcagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataaggtaggatttaagcacctctcccttccccaaaactccttatgggtacctttttcccttttcctcgtgatcgtaatatcccatctgtggctgagagtaggagcct

SEQ ID NO: 423336 - DNA, 2601 bp, Homo sapiens
ccctctggcggcccgccgtcccagacgcgggaagagcttggccggtttcgagtcgctgacctgcagcttccctgtggtttcccgaggcctccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaaccgtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcaagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcacgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaa

SEQ ID NO: 423337 - DNA, 2395 bp, Homo sapiens
ccctctggcggcccgccgtcccagacgcgggaagagcttggccggtttcgagtcgctgacctgcagcttccctgtggtttcccgaggcctccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaaccgtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcaagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcacgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaa

SEQ ID NO: 423338 - DNA, 666 bp, Homo sapiens
aaaaatatatacctcattataaaatccaccgaattaaacaaatttaaataaattttaggggtaaaagcatgtctacgaagaaaagtatgtgaacaggaagaaaagtatgaaattcctgaaggtccacgcagaagcaggctcaacagagaacagctgcacttgattctgaaagatgatcacgatgagcagtaaaatccagaagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaa

SEQ ID NO: 423339 - DNA, 2647 bp, Homo sapiens
ccctctggcggcccgccgtcccagacgcgggaagagcttggccggtttcgagtcgctgacctgcagcttccctgtggtttcccgaggcctccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaaccgtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcaagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcacgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgcacttgattctgaaagatgatcacgatgagcagtaaaatccagaagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaa

SEQ ID NO: 423340 - DNA, 1305 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggtaaataggatgatgacaatgaaaaatcatcccagtggagaacttttggttcagtggtactaccaggcaccccagctaggaaagccattgctccaggcacaggggcataaagactgcagtaggtgttcaaacctccctacaggtatcagccgatacctttagggtaaatgggaagattcttctagaaatgttactgtcaggggtacctaagacagtgatgatgatgacaaaagccagcattgccagagcaggttttctcacttgcagcactactgacatgtggggctggatcattctttgtggtgggggctgccttgtgcactataggatgttgaacagcacccctggcctccacccacgagatgccagtagcacacttgtccccagctgtgacaaagaaattgtctccagacattgctaaacgcctcctagagggcaaaatggctgcaggtgagaaccccttcttctctagagctctagctataggagttcttaacttttgtggaccatggcccttttgccagtgaagcctacagaccctttcgtgtgcagaaaatagagctagacatggtggctcatgcctgtagttctagctactcaggaggctgaggtgggaggatcacttcagcctaggagttcaacattacagtgagctatgattgtgccactgcactccagctgggcaacagagcaagagtctgtctctaaaaaattaaaattaaaaaataaagtaataatgaaaatgtta

SEQ ID NO: 423341 - DNA, 2650 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagatctatcctttcctggccttgacttccccatctgcaaatcagggtcattggctcaccctccagggctgacgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttctatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaatggcatatggactcctgaagaacttcaagccatgttgagatccattcatttgatggacattttctaagtacctgtgagccaggtgctgccatttcaaagtctcttcttaccacgctcctcagtggctagacattttcacgtggccagaaagtcccgactcttgctgggcgtccctggacaagttgccttcctcctctgagcttggcgctccccatctgtatagtggagacccttggcccccctctgtacggaagggccgatgcgaagctgcagttaaaaaaggctcacatgctcctagcctcgtgcagtcaggaggggagaccaggacagttggaaattatgattgcaaatggctttgcattttagatcattcgtgtgtgtggatcagagaaacgcacaagttccctggcacaaaggaagccctcagtagacacgtctagggcaggcttgagagatcagatggcgtgaaaggcttgtgatctgttcgtctcaggctccccctaaaccaaagaaatggaaacagctggttggggttccacgatccagctctatcaaggggctctgagtgtgcacagttgggacctggatgtatcaggtctccctcaggctggagtccactggcactcattcagccattgaacaaacatacagatgcttacctgctctgtggtcagccttgtgctgctgctgggcgggccaggagcctgcttcagtgtgagcgaggtggatgatattatagctgaagggtccctcctggtcaccctcatctcagcctaggtcaccaggatgtctgagaggggtgggtgcatgggacgggcgtggccagtctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgtggaggggcagccaataaatcattgtgaatgaaaaaaaaaaac

SEQ ID NO: 423342 - DNA, 1568 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggaggttgcagtgagctgagatcttcccactgcactccagcctggccaataagacctgtctccagcaagaccctgtctcaaaaaaaaaaaaaatggcatatggactcctgaagaacttcaagccatgttgagatccattcatttgatggacattttctaagtacctgtgagccaggtgctgccatttcaaagtctcttcttaccacgctcctcagtggctagacattttcacgtggccagaaagtcccgactcttgctgggcgtccctggacaagttgccttcctcctctgagcttggcgctccccatctgtatagtggagacccttggcccccctctgtacggaagggccgatgcgaagctgcagttaaaaaaggctcacatgctcctagcctcgtgcagtcaggaggggagaccaggacagttggaaattatgattgcaaatggctttgcattttagatcattcgtgtgtgtggatcagagaaacgcacaagttccctggcacaaaggaagccctcagtagacacgtctagggcaggcttgagagatcagatggcgtgaaaggcttgtgatctgttcgtctcaggctccccctaaaccaaagaaatggaaacagctggttggggttccacgatccagctctatcaaggggctctgagtgtgcacagttgggacctggatgtatcaggtctccctcaggctggagtccactggcactcattcagccattgaacaaacatacagatgcttacctgctctgtggtcagccttgtgctgctgctgggcgggccaggagcctgcttcagtgtgagcgaggtggatgatattatagctgaagggtccctcctggtcaccctcatctcagcctaggtcaccaggatgtctgagaggggtgggtgcatgggacgggcgtggccagtctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgtggaggggcagccaataaatcattgtgaatgaaaaaaaaaaac

SEQ ID NO: 423343 - DNA, 877 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccatctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgtggaggggcagccaataaatcattgtgaatgaaaaaaaaaaac

SEQ ID NO: 423344 - DNA, 838 bp, Homo sapiens
ggacgcgtgggtccggacgcgtgggtcgcggacgcgtgggtcgaccagcgtcggggtggttcgtcatgattgcaactgggtgggtcaaaggtaaataggatgatgacaatgaaaaatcatcccagtggagaacttttggttcagtggtactaccaggcaccccagctaggaaagccattgctccaggcacaggggcataaagactgcagtaggtgttcaaacctccctacaggtatcagccgatacctttagggtaaatgggaagattcttctagaaatgttactgtcaggggtacctaagacagtgatgatgatgacaaaagccagcattgccagagcaggttttctcacttgcagcactactgacatgtggggctggatcattctttgtggtgggggctgccttgtgcactataggatgttgaacagcacccctggcctccacccacgagatgccagtagcacacttgtccccagctgtgacaaagaaattgtctccagacattgctaaacgcctcctagagggcaaaatggctgcaggtgagaaccccttcttctctagagctctagctataggagttcttaacttttgtggaccatggcccttttgccagtgaagcctacagaccctttcgtgtgcagaaaatagagctagacatggtggctcatgcctgtagttctagctactcaggaggctgaggtgggaggatcacttcagcctaggagttcaacattacagtgagctatgattgtgccactgcactccagctgggcaacagagcaagagtctgtctctaaaaaattaaaattaaaaaataaagtaataatgaaaatgtta

SEQ ID NO: 423345 - DNA, 1713 bp, Homo sapiens
caaagtctcttcttaccacgctcctcagtggctagacattttcacgtggccagaaagtcccgactcttgctgggcgtccctggacaagttgccttgaccctctgagctgggaggcttcctgcgctcagatctatcctttcctggccttgacttccccatctgcaaatcagggtcattggctcaccctccagggctgacgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttctatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaatggcatatggactcctgaagaacttcaagccatgttgagatccattcatttgatggacattttctaagtacctgtgagccaggtgctgccatttcaaagtctcttcttaccacgctcctcagtggctagacattttcacgtggccagaaagtcccgactcttgctgggcgtccctggacaagttgccttcctcctctgagcttggcgctccccatctgtatagtggagacccttggcccccctctgtacggaagggccgatgcgaagctgcagttaaaaaaggctcacatgctcctagcctcgtgcagtcaggaggggagaccaggacagttggaaattatgattgcaaatggctttgcattttagatcattcgtgtgtgtggatcagagaaacgcacaagttccctggcacaaaggaagccctcagtagacacgtctagggcaggcttgagagatcagatggcgtgaaaggcttgtgatctgttcgtctcaggctccccctaaaccaaagaaatggaaacagctggttggggttccacgatccagctctatcaaggggctctgagtgtgcacagttgggacctggatgtatcaggtctccctcaggctggagtccactggcactcattcagccattgaacaaacatacagatgcttacctgctctgtggtcagccttgtgctgctgctgggcgggccaggagcctgcttcagtgtgagcgaggtggatgatattatagctgaagggtccctcctggtcaccctcatctcagcctaggtcaccaggatgtctgagaggggtgggtgcatgggacgggcgtggccagtctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgtggaggggcagccaataaatcattgtgaatgaaaaaaaaaaac

SEQ ID NO: 423346 - DNA, 446 bp, Homo sapiens
cacagtctgcccatcccctggcactcactgttctctccccaaaaggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggtaaataggatgatgacaatgaaaaatcatcccagtggagaacttttggttcagtggtactaccaggcaccccagctaggaaagccattgctccaggcacaggggcataaagactgcagtaggtgttcaaacctccctacaggtatcagccgatacctttagggtaaatgggaagattcttctagaaatgttactgtcaggggtacctaagacagt

SEQ ID NO: 423347 - DNA, 1393 bp, Homo sapiens
  misc_feature (1250)..(1250): n is a, c, g, or t
  misc_feature (1256)..(1257): n is a, c, g, or t
  misc_feature (1262)..(1262): n is a, c, g, or t
  misc_feature (1271)..(1271): n is a, c, g, or t
  misc_feature (1280)..(1280): n is a, c, g, or t
  misc_feature (1310)..(1310): n is a, c, g, or t
  misc_feature (1315)..(1315): n is a, c, g, or t
  misc_feature (1319)..(1319): n is a, c, g, or t
  misc_feature (1326)..(1326): n is a, c, g, or t
  misc_feature (1342)..(1342): n is a, c, g, or t
  misc_feature (1348)..(1348): n is a, c, g, or t
  misc_feature (1363)..(1363): n is a, c, g, or t
  misc_feature (1372)..(1372): n is a, c, g, or t
  misc_feature (1380)..(1380): n is a, c, g, or t
  misc_feature (1385)..(1385): n is a, c, g, or t
  misc_feature (1388)..(1388): n is a, c, g, or t
  misc_feature (1390)..(1390): n is a, c, g, or t
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaactccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactcctgcctcagcctcccgagcagctgggactacaggtgcccgccaccacgcccgtctctactaaaaatacaaaaaattagcngggcgnngtggngggcgcctntagtcccanctactcgggaggctgaggcaggagaatggngtgancccnggaggcngagcttgcagtgagcngagatngcgccactgcactcnagcctgggngacagagngagantcngnctc

SEQ ID NO: 423348 - DNA, 790 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaatagagacggaatttcaccatggtggccatgactggtccccaactcctgacctcaggtgatctgcccgcctccacctcccaaagtgctgagattacaggcctgagccaccggcccagccatggcatctgttttaccagaagagatcaacacaccctctgaaacatgatacaggacactgatctg

SEQ ID NO: 423349 - DNA, 634 bp, Homo sapiens
taggaagtgggtgttgagctttaacgctcctggtcccaattcggcacgaggaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactccttcccagctacttgagaggctgaggtgggaggattgtttgaacccaggaggttgaggctacagtgagctgtgattgtgccactgcactccaggttgggtaatgcagcgagactgcgtctc

SEQ ID NO: 423350 - DNA, 399 bp, Homo sapiens
aaagcgaaccccagggtcaccacctcctaggttgacacacattgtcaccgctccattctttccacttaaaccttccccaccagcaccccagggcctgatttttatgacaagaagacaagaaaatgatttgaggacagcttcaatcgcggtgtgaagaagaaagcagcaaaacgaccactgaaaacaacgccgctgggagggtatatctggtctttgtcacttcgtcgtggacagaagcgtaaattaggacctttactctgaaatggacatttttgagaagagtgaaatgagttacactttacaagattctttttgttgctgtgttaagaatggaagagggttaagggcagaattagggagacaaattaggagtctacagcaagagacagtgttggcttg

SEQ ID NO: 423351 - DNA, 349 bp, Homo sapiens
gaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccacttaggagttttttgtgagttatgtccttgttgcttttgcctctttttctttctagccttgattgtgccagaagacaatgtccctattcacacactctttctgcttttctgtgggccggtacaggtcccggttaccgtacagctctttcagagccttcacgcacttcacgcaaactct

SEQ ID NO: 423352 - DNA, 3031 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcacggggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423353 - DNA, 2636 bp, Homo sapiens
tttgactttccaatggaagagatttattgatggatggtaatgcaggtgctaaggggcagccaaaggatccttctcatcatgagtactgctgtgatccttttttttttttaagtatgaagacagctgttcattgtttctgacatctcagagtcctcagtagaggggacacccaagctagaatgagggatcggagaggggagtctggacgctcagtaggggcgagtagagtgtggttggtcttatttccattctcttggttttccctcctcaccagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423354 - DNA, 2470 bp, Homo sapiens
gaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccacttaggagttttttgtgagttatgtccttgttgcttttgcctctttttctttctagccttgattgtgccagaagacaatgtccctattcacacactctttctgcttttctgtgggcgaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423355 - DNA, 2790 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423356 - DNA, 2795 bp, Homo sapiens
aaagcgaaccccagggtcaccacctcctaggttgacacacattgtcaccgctccattctttccacttaaaccttccccaccagcaccccagggcctgatttttatgacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423357 - DNA, 2344 bp, Homo sapiens
tcgaactcgggatccgttccaggttaaggatagaaagaagcagaagccacacggacatggatctcactcacctcctaattctagattgggagtcaaaggcaaaggaggatgtagagttaaagaagacactaataatacactctttctgcttttctgtgggcgaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423358 - DNA, 2486 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcacgcacacgcacacacacacacacacactccattcactgtctccatgactctggagtaaactaacgtctcgagttgccattggaagccccattgtcctcattttgttttgttttgtttgtttgagacggggtctcgctctgtcccc

SEQ ID NO: 423359 - DNA, 2264 bp, Homo sapiens
tttgactttccaatggaagagatttattgatggatggtaatgcaggtgctaaggggcagccaaaggatccttctcatcatgagtactgctgtgatccttttttttttttaagtatgaagacagctgttcattgtttctgacatctcagagtcctcagtagaggggacacccaagctagaatgagggatcggagaggggagtctggacgctcagtaggggcgagtagagtgtggttggtcttatttccattctcttggttttccctcctcaccagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423360 - DNA, 1970 bp, Homo sapiens
gaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccacttaggagttttttgtgagttatgtccttgttgcttttgcctctttttctttctagccttgattgtgccagaagacaatgtccctattcacacactctttctgcttttctgtgggcgaacatggaaggggtgctgatggacgtggactgtgagagcgtctaccccattgtgtaggcctctaattgaggcctggcctctgctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423361 - DNA, 1384 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaagctggagtgcaatggcgcgatcttggcccactgcaacctccacctcccagattgaagcaattctcctgcctcagcctcccgagtagctgggaccacaggaaatggattgcatgattgttttgaccatttttcttcatgctaaataaagtatgcagacttaagcattg

SEQ ID NO: 423362 - DNA, 941 bp, Homo sapiens
agccactgcactccagcctgggcaacagggcaagaccctgtctcaaaaaaaaaaaaatttaatttgaacacttctgttttgtgcagttttctctgttatattttactttttaaaaagaaaaagcagctgggcgcggtggctcacgcctgtaatcccagcactttgggaggccaaggtgggtagatcacctgatgtcaggagttcgagaccagcctgaccaacatggagaaacctcgtctctactaaaaacacaaaaaattagccgggcgtggtggcgcatgcctgtaatcccagctacttgggaggctgaggcaggagaatcgcttgaacctaggaggcagaggttgcagtgagctgagatcgcaccactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423363 - DNA, 1094 bp, Homo sapiens
gcaatggcgcagtcttggctcatggcagcctccacctcctgggtttaagtgattcgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423364 - DNA, 806 bp, Homo sapiens
tccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggctgggcgcggtggctcacgcctgtaatcccagcactttgggaggccaaggtgggtagatcacctgatgtcaggagttcgagaccagcaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423365 - DNA, 1004 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggttcttcaaataacctggagagcgggcaggaggcctctgtgaaggctggcttgcgcct

SEQ ID NO: 423366 - DNA, 753 bp, Homo sapiens
ttctcacctcctcattggcccagtttccttatctgtcaatgagagtagctgtaaaatatggttaatgtgaggaccaaacaggtcaattagggaaaagcagtgtctctgccagcacctgacacttctttttttttttttttgagccaagatcgtgtcactgcactctagcctaggtgatacagcgagactcagtctcaaaaaataaaggaagaaaaagaaaccaggtgactgttgtgcccgtctcttgtccccgatctttctcccaatcctgaggtccatcagctggaaggacatatccatccggaggcctccccaagtgtggtgggagaaatccatcccctctctgacactccccccgcctttccctcccgacacccagtccccgggagatcaaaatttaacctggtgttatctaggctggagcctgaagagcctggtgggaagtggaggacggagaggaggggcatggacccagaaagtagcaggaagtcttcagagacccttatttttaaattatttatttttgtttgttttgtttttttgtttccctcgacaacaagagccaaactccgtctcaaaaaaaaaaattaaataacagcaagcaactgcatgcacgtctgggggcggtgtccggggtgagaaaggccccgccagcaatccatcccacaatcagcgatggctgagggggtctggacctcgcgggacggggctgcacgcccccaagcaaatgcacagcgcggctaaattggattc

SEQ ID NO: 423367 - DNA, 916 bp, Homo sapiens
tacacttcagcctgggtgacagaatgagactccgtcttaaaaaaaaaaaaaaaaaaaatttaaataaaatgcatgcaatgtggtccaggcgtggtggtgcatgcctgtaaccccagcactttgggagatagaggcagatcacttgaggtcaggagttcaagaccagcctggccaacatggcaaaaccccatctctactaaaatccaaaaattagtcgggtatggcagtgcacgcctgtagtcccagatactcagaaggctgaggcaggagaatcatttgaacctgggaagtggaggttgcagtgagccaagatcgtgtcactgcactctagcctaggtgatacagcgagactcagtctcaaaaaataaaggaagaaaaagaaaccaggtgactgttgtgcccgtctcttgtccccgatctttctcccaatcctgaggtccatcagctggaaggacatatccatccggaggcctccccaagtgtggtgggagaaatccatcccctctctgacactccccccgcctttccctcccgacacccagtccccgggagatcaaaatttaacctggtgttatctaggctggagcctgaagagcctggtgggaagtggaggacggagaggaggggcatggacccagaaagtagcaggaagtcttcagagacccttatttttaaattatttatttttgtttgttttgtttttttgtttccctcgacaacaagagccaaactccgtctcaaaaaaaaaaattaaataacagcaagcaactgcatgcacgtctgggggcggtgtccggggtgagaaaggccccgccagcaatccatcccacaatcagcgatggctgagggggtctggacctcgcgggacggggctgcacgcccccaagcaaatgcacagcgcggctaaattggattc

SEQ ID NO: 423368 - DNA, 673 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccgcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaatagagacggaatttcaccatggtggccatgactggtccccaactcctgacctcaggtgatctgcccgcctccacctcccaaagtgctgagattacaggcctgagccaccggcccagccatggcatctgttttaccagaagagatcaacacaccctctgaaacatgatacaggacactgatctg

SEQ ID NO: 423369 - DNA, 2914 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423370 - DNA, 3958 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcacgcacacgcacacacacacacacacatccagcctaggcaacaagagtgaaactctgtcttaaaaaaaaaaaattaaaaattatattcgggccgggcttggtggctcaatcctataataccagcaccttgggaggccaaggcaggaggatcacttgaggccaggagttcaagaccggcctgggcaacataatgagaacccatctttaccaaaaaaataaaattacattaaaaattagctgggcacggtgacgtctgcctgaggtcacattcaagaagctgatgtgggaggatcgcttgagcccaggaattggaggctgcagtgagctaagatcataccactgcacttcagcctgggcgtcagagtgagaccctgtttctaaaataataataattttaaaaaatgatatttatggttgcattgggaaaagatcaatctattaatatatgtgaagacatttttggcctaaaagttatatatattttttccttctgattttaaaagaaatgaggccaggcgtggtggtgcatgcctgtaaccccagcactttgggagatagaggcaggtggatcccttgagcttaggaatttgagactaggctgggcaacatagtgagacctcatctctaaaattaaaaaaataaaagccaccagaaaaaaacctaaaaacatgccaagtgacatcagtctttgatgaaaatggcagcagaagagtgatgccatgggtgggggtgggaaatgctatttcagcagagagggagctgtcacggaagacaccatgtggctgggcacggtggctcacacctgtaatcccaacacgttgggaggccaaggtgggcagatcacttgaggtcaggagttcaagaccagcctggccaacatggcaaaaccccatctctactaaaatccaaaaattagtcgggtatggcagtgcacgcctgtagtcccagatactcagaaggctgaggcaggagaatcatttgaacctgggaagtggaggttgcagtgagccaagatcgtgtcactgcactctagcctaggtgatacagcgagactcagtctcaaaaaataaaggaagaaaaagaaaccaggtgactgttgtgcccgtctcttgtccccgatctttctcccaatcctgaggtccatcagctggaaggacatatccatccggaggcctccccaagtgtggtgggagaaatccatcccctctctgacactccccccgcctttccctcccgacacccagtccccgggagatcaaaatttaacctggtgttatctaggctggagcctgaagagcctggtgggaagtggaggacggagaggaggggcatggacccagaaagtagcaggaagtcttcagagacccttatttttaaattatttatttttgtttgttttgtttttttgtttccctcgacaacaagagccaaactccgtctcaaaaaaaaaaattaaataacagcaagcaactgcatgcacgtctgggggcggtgtccggggtgagaaaggccccgccagcaatccatcccacaatcagcgatggctgagggggtctggacctcgcgggacggggctgcacgcccccaagcaaatgcacagcgcggctaaattggattc

SEQ ID NO: 423371 - DNA, 2861 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423372 - DNA, 2650 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcactgcaccccagcctgggcaataagagtgaaactccatctccaaaaaaaaaaaaaaaaggtacatgaaacatatgaagcaaaaagtgaaagtccccattcttttcctttttccagaggtgatttttgtggccaatctggtttcattccctcccagacacttttctaggcatctatgtgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtggacaacttagcaaaacaccatctctaaaaaaaaaaaaaaagggtacttgaaccttttgaggcaaaaagtgaaggtccccattctttcctttttcccagaggttgtttttggtggcccaaatctggttttcatttcccctcccagaaacactttt

SEQ ID NO: 423373 - DNA, 3019 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctggtgtctcttttcctctctcagctccttggggctttccttagctctgcacctccttttcctttatcatctccttgggccatctcctccgtctgtggtcatgattacacctccttgtttcctcctgtgctgagccctttccttgtgtccattccaccagacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtgtgtggaatattttgatgagacgcatgtctgagccgcacttgaccactacctagattggctgatacacaatcagcagcaccacgatagccaccacctcctgcattcccccgatccgcctcagcctcccgagcagctgggactacaggtgcccgccaccacgcccggctaacttttttgtatttttggtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcacgcacacgcacacacacacacacacatccagcctaggcaacaagagtgaaactctgtcttaaaaaaaaaaaattaaaaattatattcgggccgggcttggtggctcaatcctataataccagcaccttgggaggccaaggcaggaggatcacttgaggccaggagttcaagaccggcctgggcaacataatgagaacccatctttaccaaaaaaataaaattacattaaaaattagctgggcacggtgacgtctgcctgaggtcacattcaagaagctgatgtgggaggatcgcttgagcccaggaattggaggctgcagtgagctaagatcataccactgcacttcagcctgggcgtcagagtgagaccctgtttctaaaataataataattttaaaaaatgatatttatggttgcattgggaaaagatcaatctattaatatatgtgaagacatttttggcctaaaagttatatatattttttccttctgattttaaaagaaatgaggccaggagtgagccaccacgccgcagcctcccgttgtcctcatttagactttcctgggttataggcacttttgactacctggggtccttcttcagttaaataaaaacaaattacaaacattaggccgggcgtgaatggcacattgcctgtaatcccaagcacttactga

SEQ ID NO: 423374 - DNA, 1129 bp, Homo sapiens
gagcacaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcacggggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggcgcccagaggactttcttccagcttctgctgtccttctttgtggagagcaagctggagtgcaatggcgcgatcttggcccactgcaacctccacctcccagattgaagcaattctcctgcctcagcctcccgagtagctgggaccacaggaaatggattgcatgattgttttgaccatttttcttcatgctaaataaagtatgcagacttaagcattg

SEQ ID NO: 423375 - DNA, 1359 bp, Homo sapiens
caccaaagagccgtgcaagcagacaggtcacactttcagcagatgagcttgaacctcaggagggttgtggcacaatgaggaaggaaacgtgggtggaaaggcacgctggcctgctctgctggctgggccagtaactggggatggggctggggcagggcccactaagccactggtgactgggggaggggctggggaactgggtagcagacacaggctgaggatcggcacgggagcatggcagccaacgtctcgggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgctctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatga

SEQ ID NO: 423376 - DNA, 1309 bp, Homo sapiens
caccaaagagccgtgcaagcagacaggtcacactttcagcagatgagcttgaacctcaggagggttgtggcacaatgaggaaggaaacgtgggtggaaaggcacgctggcctgctctgctggctgggccagtaactggggatggggctggggcagggcccactaagccactggtgactgggggaggggctggggaactgggtagcagacacaggctgaggatcggcacgggagcatggcagccaacgtctcgggtaaggagaaggcatgttggctgtctctgggggtctgcagattgtcaggaggtgggggtagtgggtattggtaaaacacctaggtctggggctgggcacggtggctcacgcctgtaatcccagcactttgggaggtcgaggggggtggaacacgaggtcaggggttcgagaccaccctgaccaacaaggagaaaccccgtctctactaaaaataaaaaaattagctgggcctggtggcacatgcctgtaatcccagctactcgggaggctgagacaagagaatcacttaaacccgggaggcggaggttgccatgagccgagattgcaccattgcactccagcttgggcaatgagcgaaactccatctcaaaaaaaaaaagcctaggtcaaggctgggtgtggtgatgcgagcctgtgattccagctactcgggaggctgaggcagggggatcacttgaccccaggaggtcgagactgcactgagctgtgattgcaccactgcacctcagcctcggtgacagtgaaatcctgtctccaaaaaaaagccacgtctagacgacacttcctccttaagcaggctggcgttgggagcagggaggcgcctccggagaagcctgtccccagcctgcagaggcaggggtggggtgcacaaggagtgagtgcccctgtgctgctgtgccctgggcactgtggtgagcactggcaccagtaatgggtaagcaggcccccccatcctcccgaaggagggagatttttctcaccgtcatcaggtggcgcagggtatgggggaaaataacgcagggaagggagagtggaggcacgagggctgctgtcaacagtggttagggtggccttggggcctctcgcaggcaggaccacggacgtgggaagaggagcctcaagaatgtctgggtgtggctgggcacggtggctcacacttgtaatctcagcactttgggaggctgaggcgggcagatctgaggtcaggaattcgagacctcttggccaacatggggaaaccccatctctactaaaaatgcaaaatttaaaattaaa

SEQ ID NO: 423377 - DNA, 740 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttccaaaaaaacacaaaacaatacaaacaagaaacaaccccaagggagctcaatatccggggggcgggagaagacgggcgtactagaacgggccatgtggcccacacggtccctgacccagtttcttggcccaggggggaacggccggccccaaagaggccgaataatcgaacccggtccgaaatcgccaca

SEQ ID NO: 423378 - DNA, 657 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcatcagaccacgaagcttctggccaaggcttcaccaacttcacttgatgctgtgaggaacagaactgcccatccaagccctgccagaatttctaacccacaaagccatgagtcacaataaatgccatgggaca

SEQ ID NO: 423379 - DNA, 492 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaaggtagagcctaaatgtggttggtgcaggcaggaaatattaactcatttcattgtcacacgaaaccagaagacataaaacagttaaaataggccaggcacagtggctcacacctgtaatcccagcactttgggaggccgaggcgggtggatcacgaggtcaggaggagaccatcctggccaacgtggtgaaactcggtctatactaaaaa

SEQ ID NO: 423380 - DNA, 1771 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagggaagtcgcaggaatgtgagaaggccaggaaggattgtgagccaataatacatcttgacaatccacaatagatggaagctattattgattcattatctcaaaatggctccaccagccaaccccttctatccatccccagtgccacctcctaattcaggtcctcgacgctttttgcttgcatggctgccagagcctttgggcaggtctctctgtgttgatgtgttcacccccactcctatctcctccatccaacgctctaccaccaaggcaatcctcctaaaacacaaccacagtgttcttcacactccctatgattccctgcaacccacattattaatcattaatccaattaataaaaattaatgtactaatccccagctcctcagtgtggcccttcacaatctgcttgtccagcctcgtctcttgcctccccagctttccccagcagacccctctcccatccattccaatgccatcctcttctcccagcctagttctttcaggccctgtgcctttggcacttgcccctgcctgaaatgtccttcccacttcttcttgaagggggtgagtgccaactcacctttccaaccgcacaccaatgcacaccaggatctcccccaagactccagggtagtagtcaccatctgtatttctgcagcacactgcacctgcctctagcacagctcgacagcccactgaagtgaatgatctgttcgatcagtgccgacttgcctttctttcccagctgcaaaccacccaaggtgaagtcatcttagcctcttggagtcagcctgactggggtgaacccattgatatgtattgcataaatgaacatatgacagtagtgatgaaggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423381 - DNA, 1026 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagctgcaaaccacccaaggtgaagtcatcttagcctcttggagtcagcctgactggggtgaacccattgatatgtattgcataaatgaacatatgacagtagtgatgaaggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423382 - DNA, 1737 bp, Homo sapiens
gttccctggagcttgctcttctcattgtgcaggggtggggtcagtgctgccacccaacaccacattcagttagagcctccagtcagaccaggcatgcactaactctgctcatgcatctctagccaaagctggtcatgtgcacagcaagaaatctgctctgtcctgtccacagggaagtcgcaggaatgtgagaaggccaggaaggattgtgagccaataatacatcttgacaatccacaatagatggaagctattattgattcattatctcaaaatggctccaccagccaaccccttctatccatccccagtgccacctcctaattcaggtcctcgacgctttttgcttgcatggctgccagagcctttgggcaggtctctctgtgttgatgtgttcacccccactcctatctcctccatccaacgctctaccaccaaggcaatcctcctaaaacacaaccacagtgttcttcacactccctatgattccctgcaacccacattattaatcattaatccaattaataaaaattaatgtactaatccccagctcctcagtgtggcccttcacaatctgcttgtccagcctcgtctcttgcctccccagctttccccagcagacccctctcccatccattccaatgccatcctcttctcccagcctagttctttcaggccctgtgcctttggcacttgcccctgcctgaaatgtccttcccacttcttcttgaagggggtgagtgccaactcacctttccaaccgcacaccaatgcacaccaggatctcccccaagactccagggtagtagtcaccatctgtatttctgcagcacactgcacctgcctctagcacagctcgacagcccactgaagtgaatgatctgttcgatcagtgccgacttgcctttctttcccagctgcaaaccacccaaggtgaagtcatcttagcctcttggagtcagcctgactggggtgaacccattgatatgtattgcataaatgaacatatgacagtagtgatgaaggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423383 - DNA, 1741 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagagccagctcaatcacttctccagaaagacttactgagtcctctgcactgaacaggtgtcctatgctccaggagagccctgggctggctcctagtgcagccgttatgaccctggaatgcaccatctttcacatcactgcctggccttctagaatctcagcttcttaaatcaagaaattgtgtcttgttcatgtctgaattccccaagtgaacacagtgagtgggtgcttgacaaatctttgttggtaatgagcaaaaaaggggattctgtgcccaataccatgaaatcaatgcacagaagattcagtcaatcaagaaaggtgcacagacactggccacacacactgacatttgtttgcagatgttccagtccccctgacttccaccaatccattcattcattccacaagcatttttgctggggtggaagcagggccatacagggtgtgtacatcacagataggggattctgctgcaactatctcccagaccctattctagggccaggggatagaaacagaatcaaaaacatattcattgtcttttttgggcttatattattgaggagagagaaataaacaatttcaaaataaacagtgtcatacagcgctaagtgctgtaaataaaatcaaacagaataacgaaagagaaagtagctagactggagggaaaagctgcttcagaatgagttgtcaaggaagcctctttgcaatcagaaaggtgagaaggatttagtcaggcaaatatcaggagtaaattattcttggaggaaagtaagcccatgcaaaggccctggggcagagtgggcttatttgataaagaggtaaaagggtcaggatatctgtagcaatagtggccaagggagggagaggtatgagacagaggaggtgagccctgttgccatggtgagggcatgaggatttattctaagttccagatacctggagttaaagtcccctgaactggacaacaactacaagccttcatatctcaatgctaccatctttaagcccccgttataagagctcagaggcttcagagatgacaggaaacaccagaacgctatggtggtgcatatctaggtgccttctcccaactcagatcctttgactgtagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtgcaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactac

SEQ ID NO: 423384 - DNA, 1637 bp, Homo sapiens
ccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctatgctccaggagagccctgggctggctcctagtgcagccgttatgaccctggaatgcaccatctttcacatcactgcctggccttctagaatctcagcttcttaaatcaagaaattgtgtcttgttcatgtctgaattccccaagtgaacacagtgagtgggtgcttgacaaatctttgttggtaatgagcaaaaaaggggattctgtgcccaataccatgaaatcaatgcacagaagattcagtcaatcaagaaaggtgcacagacactggccacacacactgacatttgtttgcagatgttccagtccccctgacttccaccaatccattcattcattccacaagcatttttgctggggtggaagcagggccatacagggtgtgtacatcacagataggggattctgctgcaactatctcccagaccctattctagggccaggggatagaaacagaatcaaaaacatattcattgtcttttttgggcttatattattgaggagagagaaataaacaatttcaaaataaacagtgtcatacagcgctaagtgctgtaaataaaatcaaacagaataacgaaagagaaagtagctagactggagggaaaagctgcttcagaatgagttgtcaaggaagcctctttgcaatcagaaaggtgagaaggatttagtcaggcaaatatcaggagtaaattattcttggaggaaagtaagcccatgcaaaggccctggggcagagtgggcttatttgataaagaggtaaaagggtcaggatatctgtagcaatagtggccaagggagggagaggtatgagacagaggaggtgagccctgttgccatggtgagggcatgaggatttattctaagttccagatacctggagttaaagtcccctgaactggacaacaactacaagccttcatatctcaatgctaccatctttaagcccccgttataagagctcagaggcttcagagatgacaggaaacaccagaacgctatggtggtgcatatctaggtgccttctcccaactcagatcctttgactgtagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtgcaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactac

SEQ ID NO: 423385 - DNA, 1028 bp, Homo sapiens
tacatgacatcagcagatgtcctcctccatgacaacaccgcccactaatcaccacccaacaatgcacaccaggatctcccccaagactccagggtagtagtcaccatctgtatttctgcagcacactgcacctgcctctagcacagctcgacagcccactgaagtgaatgatctgttcgatcagtgccgacttgcctttctttcccagctgcaaaccacccaaggtgaagtcatcttagcctcttggagtcagcctgactggggtgaacccattgatatgtattgcataaatgaacatatgacagtagtgatgaaggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423386 - DNA, 1195 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggtcgacagccaaaagcgggaggtatccaaagctgcaagagaagagaaaatggcctgtggtggggagcagcttccaagccaccatggaggccccactcaagtcccaggcctcatgggagctgaccctgatgcacggggactgagtcacccctgacagaacaataaggagacctcgtggcatttcccatctccacagaaaccaccaaatccatgtctgccatgatcctgctcacttcctcacccacccttccctgcaatccatccctaatgagcgctctttgaacccatccaactctctccatctctacagccctcgcccagcctcagtttcctcatttgaaagatgggaattctaacacgtgtctgagagggcttagatgagaattaagtttgcaaaactgaaagcagtgacttttgtttgtgttgctcacggaacctacacactgttccctgcttctcaggctcttctctgtcccagttctctccctttctgccaccccttgagttgtcaggctcctcactcctgcttcaggctgcacccttcttcagcttcctccactccctggctgtggcaggcagcctctagcatgaccctcaatgatccccagctcctgcagtcaccctcttgtggagtccccacccctttagtgtgggatgcacctaacgactcacttccaactcacaaaatatggcaaaagacacaggaagtcacttctgaaattaggttgcaaaaggacctgttatccctcttgctcatcttctcctgaaagacaggtggcagagctgccatgctgcgaagcaccctacgcggcaaggggcccagggagtactcctgtcaacagccagcaaggaactcagaccctcagcccaacaagccacagctgaatcctgccaacagtcacatgagtagatgagcaagagggataacaggtccttttgcaacctaatttcagaagtgacttcctgtgtccttttgatcttggtgttgat

SEQ ID NO: 423387 - DNA, 656 bp, Homo sapiens
cccccccttttttggggtttgccccaaaggggtgggaaaggcccccaaccccccttttaaaagggaaagccttgggggcaatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423388 - DNA, 629 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcccacccacccatttatccgctcatccacctagtgaatggggagcccatccatccatgcatcaatccattacccttcccttaacaatcctctttttctcaattctgattctggggacaatcatagaaattgctgtcgccttaatccaagcttaagttttcacacttatagtaagcctcaacctggtcgacaacacata

SEQ ID NO: 423389 - DNA, 1022 bp, Homo sapiens
tgagttgtcaggctcctcactcctgcttcaggctgcacccttcttcagcttcctccactccctggctgtggcaggcagcctctagcatgaccctcaatgatccccagctcctgcagtcaccctcttgtggagtccccacccctttagtgtgggatgcacctaacgactcacttccaactcacaaaatatggcaaaagacacaggaagtcacttctgaaattaggttgcaaaaggacctgttatccctcttgctcatcttctcctgaaagacaggtggcagagctgccatgctgcgaagcaccctacgcggcaaggggcccagggagtactcctgtcaacagccagcaaggaactcagaccctcagcccaacaagccacagctgaatcctgccaacagtcacatgagtagatttggaaacaaatcctctgccacctctcggaaagtcaagccttgaaatgaatgcagccccagccaacagtttcagcctgggaatggccctgtgcagagatactcagctaaaactgtagttggattcataagtcagagaaactatgaaatcataaatgtacattgttttaagttgctgagtattggggtggtctcttccatagcaatacgtaactgagacacatagccttcatttgtatctccatacagaacactccctggtatatacagccgacctctgtatccagggacctgtgtctgtggattgaaccaaccacagatcaaaaatattcaaaaagtaggctgggcacagtggttcacacctataatcccagaactttgggaggccgaggcaggtggatcacctgaggtcaggagttcaaggccagcctggccaacatggtgaaaccccatctctactaaaaatgcaaaaaattagcaaggtgtagcggcatgtgcctgtaatcccagctactcagggggctgaggcaggagaatcccctgaacccaggaggcgaagcttgcagtaagccaagatcatgccactgcactccagcctgggcaacagtgaagc

SEQ ID NO: 423390 - DNA, 689 bp, Homo sapiens
ccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctatgctccaggagagccctgggctggctcctagtgcagccgttatgaccctggaatgcaccatctttcacatcactgcctggccttctagaatctcagcttcttaaatcaagaaattgtgtcttgttcatgtctgaattccccaagtgaacacagtgagtgggtgcttgacaaatctttgttggtaatgagcaaaaaaggggattctgtgcccaataccatgaaatcaatgcacagaagattcagtcaatcaagaaaggtgcacagacactggccacacacactgacatttgtttgcagatgttccagtccccctgacttccaccaatccattcattcattccacaagcatttttgctggggtggaagcagggccatacagggtgtgtacatcacagatagggtgggtttgtataatgagtataaaaaacttctagcagaagatgacaaagtatatcaagaaagggctctcttcgaaatcacaccactgcactccagcctgggtaacagagggagattccatctaaa

SEQ ID NO: 423391 - DNA, 959 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423392 - DNA, 881 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacctgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataactataga

SEQ ID NO: 423393 - DNA, 579 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcatcagaccacgaagcttctggccaaggcttcaccaacttcacttgatgctgtgaggaacagaactgcccatccaagccctgccagaatttctaacccacaaagccatgagtcacaataaatgccatgggaca

SEQ ID NO: 423394 - DNA, 644 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcatcagaccacgaagcttctggccaaggcttcaccaacttcacttgatgctgtgaggaacagaactgcccatccaagccctgccagaatttctaacccacaaagccatgagtcacaataaatgccatgggacaaaaacaaaaaatgcatgttgcttttgtcatacattagtggtagttcatcgcacggcaatagaaaa

SEQ ID NO: 423395 - DNA, 793 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaagagccagctcaatcacttctccagaaagacttactgagtcctctgcactgaacaggtgtcctatgctccaggagagccctgggctggctcctagtgcagccgttatgaccctggaatgcaccatctttcacatcactgcctggccttctagaatctcagcttcttaaatcaagaaattgtgtcttgttcatgtctgaattccccaagtgaacacagtgagtgggtgcttgacaaatctttgttggtaatgagcaaaaaaggggattctgtgcccaataccatgaaatcaatgcacagaagattcagtcaatcaagaaaggtgcacagacactggccacacacactgacatttgtttgcagatgttccagtccccctgacttccaccaatccattcattcattccacaagcatttttgctggggtggaagcagggccatacagggtgtgtacatcacagatagggtgggtttgtataatgagtataaaaaacttctagcagaagatgacaaagtatatcaagaaagggctctcttcgaaatcacaccactgcactccagcctgggtaacagagggagattccatctaaa

SEQ ID NO: 423396 - DNA, 722 bp, Homo sapiens
agcgcgggcgcaggcgccgagaggcgcacgggagacctcaggcccagactccactccccagctgtgaaaggactgctggccagacccccaagctagcccgccaggcctccatagagctgcccagcatgactgcgtccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcatcagaccacgaagcttctggccaaggcttcaccaacttcacttgatgctgtgaggaacagaactgcccatccaagccctgccagaatttctaacccacaaagccatgagtcacaataaatgccatgggacaaaaacaaaaaatgcatgttgcttttgtcatacattagtggtagttcatcgcacggcaatagaaaa

SEQ ID NO: 423397 - DNA, 330 bp, Homo sapiens
tctgccaggtactttggaagtagtggttagaaacatagacactggtcgggtgcagtggctcacgcctataatcccagcactttgggaggctgaggcaggtggatcacaaggccaggagtttgagactagcctggccaacacggtgaaaccctgtttctactaaaaatacaaaaattagccggctgtggtggtgcatgcctatgatcacagctactcaggaggctaaggcaggagagttgcttgaacccgggaggcggaggttgcagtgagttgagatcgcaccactgcactccagcctgggcaacagagcaagactccgtctcaaaacaa

SEQ ID NO: 423398 - DNA, 1090 bp, Homo sapiens
gccaatgtccctgtggccactcagctgagaccgagggcgacctgggcagctgcccggtgtctgtcacctccgtgtcccacatagatgccaggctctgcttctgtggttctggaggtcattagtcaattgtatgtggtgctgtctgtcctcctgattgcagaggaggaaggaaccccttaaatgagcgggttctgagtgctggggccgctggtctgctctgcctggtgggattctccagtgctggcttcatctgtgccccagccccactctcaccaacaaggagggcgtgaaaatgacaaggaatccatccctagagttcacaggagatctagggcagagtttccaagctgcagctgctctggccctgtgtgagctgctgctctgaggaagccccaggctgaggcagctaccaggcggaggctgggtttggaggcctccacatcagggaattgagcggtaggggtttcagccttcacgttggtcgccgcactgtatgggaagtggggtctggggtctgcttgcccagtctcaccgtcctcttcctccccaaagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423399 - DNA, 2589 bp, Homo sapiens
tgatgagctggccgggcactttcaaaatggcggagtgtggagcgagcggcagcgggagcagcggggacagtctggacaagagcatcacgctgccccccgacgagatcttccgcaacctggagaacgccaagcgcttcgccatcgacataggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423400 - DNA, 1648 bp, Homo sapiens
gacgcaaccccagtgtcaaaccagggggtaagtcaaggtatccggctcaggccgccgggcagctgagggggcccagtgggggtctcgtctgtggcccagagacgtggcggaagaaggcagtacatctcccttcttagagagagagtggaagcttctgagtgtggcttgggtcgttctgaaccatggtgacgtttccaccctgccactgcctgtcttccagtttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423401 - DNA, 2287 bp, Homo sapiens
tgatgagctggccgggcactttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgcgtaggtgtctgcgggctcggagcaggctctgcagcctgtgggtgcctgtcctgccccaggcttgcgggcaaggaggtggagcgggtcccttgggggtcacatggcgcttggtggcttggtggctcagggctttggggcccagggagtgcacatggcagcagcgccaggggctgggcagggcgcagcgcccttgtctgtcccctcaggttctgaggaggccccttccttaagcatgggtgccgcagaggcctaagggtgtggatttgaaaatcggggctggcattttctattgtcagaatccaaattcatgtttcctatgtgtggtaggaattaaacatttctgatgtgatgatcaaagggtgctttgcaaagcagtcccctagactggcctgtaggacacgcaggtgtctagcacctggcgccgtctcctggggctctgaatcttgaaaatgaacccccccaccatcatttaccttcactcccaaagaagctgcttccagtctctgggcctccccaggcggccgcaccacctct

SEQ ID NO: 423402 - DNA, 2672 bp, Homo sapiens
tgatgagctggccgggcactttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423403 - DNA, 3110 bp, Homo sapiens
ggccgtcctgggtggctgggggccggggtccagcgttacccgccgcgaggtgggagggtcggcggaattttatgtcttcggccacatcggcatctgggcgccccggctccgccgcttggctggtggctggcctgagatttggggtccttagttctggtcgagacgaggacgagctcggcgggaagcccttggcagagtggccccgaaaaggccgcgcgttcccgcggcgtggccagctgtggcccgcgggccggacagtccgtgcacaggccccgctctctggagagtggacgccgggcgtgagttcaggcggccgtggacgtgggacctgggaactcgtgcctctggtttaaaagccacccgtgccttccgtggcctttaaggcggcctgcacttctgccctggcctctccagggtccgctgcagaccctcctgcctgatggctgtgctctcagtaatgacggcgggccaggctctgttctagacctttttcccacgctcctgactcccggacacctcccagccacctctaggggaggaacgcgaattactcccttttcgcagatgaggataccaagccccagaaaggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423404 - DNA, 1245 bp, Homo sapiens
ctgcggctgaaagtcgacaaggaggacgtgatgacgtgcctgaacgacgtgacccacagcgagtccctcatcgtggcagagcgtattgcgggcatggaccctgtcgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccggagccatctg

SEQ ID NO: 423405 - DNA, 1152 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctagggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagca

SEQ ID NO: 423406 - DNA, 383 bp, Homo sapiens
  misc_feature (364)..(364): n is a, c, g, or t
  misc_feature (383)..(383): n is a, c, g, or t
ggaccctctccctactgtatcctactcatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtacngtagggagaggtccggccn

SEQ ID NO: 423407 - DNA, 311 bp, Homo sapiens
  misc_feature (12)..(12): n is a, c, g, or t
  misc_feature (15)..(15): n is a, c, g, or t
  misc_feature (18)..(18): n is a, c, g, or t
agctgaggtganctnggnacccgactacatacttccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggacggaagtatgtagtactacatacttccggaagtatgtagtcgggtaccgagc

SEQ ID NO: 423408 - DNA, 1888 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423409 - DNA, 1637 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtaaaaaacaacctttctcttttcctctaatttcataataaaataaactctagggggggcccggtcccattggcccttatggaggcgtataccaattaatgggccgctgtttaaaatcttttgactggg

SEQ ID NO: 423410 - DNA, 1834 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtagggtttactcacataacatgtgtcagtgagttcacctgccctgtgctgtttaccacgtcaactgcctgctctgcaaggccatccatgagcagatgaactgcaaggagtatcaggaggacctggcccctgcgggctcaaaacgactgtggctgccggcaaacgacaggagatgctgaaggtgatgcttgcacaagcggcgaggtcatgccctgcccagtgcagatcgtgtaccagaagaaaggcggttgcgactggatcccgtgacccggctgcaaacgagatctgatgtcccaagggcccactggggcctggggccagagacc

SEQ ID NO: 423411 - DNA, 1794 bp, Homo sapiens
caatcatgctgcgtaggttgtagtctcctcatttatgaaacagtgatttggcctggatctaagattccttatacatgttaactaactctaaggggaaagagatagatcataaattacatgttaacgttgaggggaaattgatagatcataaattaaaatataatttaatatgttatatatttctattgatttatatacctatgaaatagtttttatattgaaaggtaggattttttttcccatttgttagcatcatgattgtgctgctgagttttaaaagattgtgctatttgaatatctcaggatcaatttctattttgtgtagtctattaatcaaatatttatcgagaacatttatatgccagactgtgctggagtcatagaatgtaatggttggcagaatctagtaaaaagaaaaagattgagcaaactcctgaatttgcaattttgaatgctttatctccaccttctatcaactgctttgagtaaataaaatttggaagtccacatttcttccctaactttctgaaagccagcatagcatggtggccagagctcagatttggagccagggtgccagtgctcttggttcccagctccatcactttctagttgaatgatcttgggcaagttacttccgtgcctcgctttctcatcagtaaaatggagacagtaacatctgccttttacagggctgttgtaaggcttacctgaatttcatatatgtaaagtgctggctcataccgtgggatatatgtttacaatagttatcaataagcaaataagtgaaaatatgccgcacaaagtgattacaatggaattattgcttttatcatgtaaatgataactttggtcttcctgttatttaacatgacttaacattctacagggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423412 - DNA, 1050 bp, Homo sapiens
gccaggatccaaatccagatcagaagaacccatcagaatcatgacagtaccatcccctggaattcaagcctgacctccacagctctagctgccgtgtcccacccacagagcagatcctctaggtattttgttgtcttcagatccaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423413 - DNA, 983 bp, Homo sapiens
atgtgtacgcgtatgtgttgcattcacacccatgtgcaggaagggggacgcgagatggcatgaaacacggcagaagcaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423414 - DNA, 2427 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggtaagtgtcaaactgctgtgtctcagtcagcttcttgtgtgcattcatagttcacataactgttctatatcattgatcattaacagaactcagtttggaagaaaaaaaagcaaaataacaagttaaatactagaacactaattattaagaaagtcctagtggagatagagaagtgacatgacataggagaggatttggctggagttggggggagttcttgctttgctgccacgtcacagtgaaatcttggcaagccaccaaactgcacacatttttctatatctttaaaataaggaatatttgccataaccaaaagaataaagatatattcaacacattagttttctgtaaaacatgcatattataagcaaaacaacagcttctggcttctctcaaacccgtgaattctgaaagaaattttctccatctatgaagtagattacgtgatttcgtgggactttgattctaatgttttaataccaccactgctctggaatctaaggctaacctaactcttttaatatctttccttcttctaggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423415 - DNA, 2761 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcaggtcagtcgtgacatgttatgaaatcacagaagcttctagaatgataggctgtatcaataacattttactgtttataggcaagaacttaatgaaaaagttattttatgaattgaattttgtcaaattagcaaaagtatcaacttcatcatagaattggcatcttttattagctactaggttgaaaaccacaaactattgtgaataaaatcaatatgggttaatgaagtagactcagaaaggagaaggtgaaacaaatgttgattaaggaggttatgagtcatggaaactcttgtaatgtacttggaagattaaaacgtttactttgtttttgcagactgtctgcaactttacagatggtgcattggttcagcatcaggagtgggatgggaaggaaagcacaataacaagaaaattgaaagatgggaaattagtggtggtaagtgtcaaactgctgtgtctcagtcagcttcttgtgtgcattcatagttcacataactgttctatatcattgatcattaacagaactcagtttggaagaaaaaaaagcaaaataacaagttaaatactagaacactaattattaagaaagtcctagtggagatagagaagtgacatgacataggagaggatttggctggagttggggggagttcttgctttgctgccacgtcacagtgaaatcttggcaagccaccaaactgcacacatttttctatatctttaaaataaggaatatttgccataaccaaaagaataaagatatattcaacacattagttttctgtaaaacatgcatattataagcaaaacaacagcttctggcttctctcaaacccgtgaattctgaaagaaattttctccatctatgaagtagattacgtgatttcgtgggactttgattctaatgttttaataccaccactgctctggaatctaaggctaacctaactcttttaatatctttccttcttctaggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423416 - DNA, 2333 bp, Homo sapiens
caatcatgctgcgtaggttgtagtctcctcatttatgaaacagtgatttggcctggatctaagattccttatacatgttaactaactctaaggggaaagagatagatcataaattacatgttaacgttgaggggaaattgatagatcataaattaaaatataatttaatatgttatatatttctattgatttatatacctatgaaatagtttttatattgaaaggtaggattttttttcccatttgttagcatcatgattgtgctgctgagttttaaaagattgtgctatttgaatatctcaggatcaatttctattttgtgtagtctattaatcaaatatttatcgagaacatttatatgccagactgtgctggagtcatagaatgtaatggttggcagaatctagtaaaaagaaaaagattgagcaaactcctgaatttgcaattttgaatgctttatctccaccttctatcaactgctttgagtaaataaaatttggaagtccacatttcttccctaactttctgaaagccagcatagcatggtggccagagctcagatttggagccagggtgccagtgctcttggttcccagctccatcactttctagttgaatgatcttgggcaagttacttccgtgcctcgctttctcatcagtaaaatggagacagtaacatctgccttttacagggctgttgtaaggcttacctgaatttcatatatgtaaagtgctggctcataccgtgggatatatgtttacaatagttatcaataagcaaataagtgaaaatatgccgcacaaagtgattacaatggaattattgcttttatcatgtaaatgataactttggtcttcctgttatttaacatgacttaacattctacagggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggtaagtgtcaaactgctgtgtctcagtcagcttcttgtgtgcattcatagttcacataactgttctatatcattgatcattaacagaactcagtttggaagaaaaaaaagcaaaataacaagttaaatactagaacactaattattaagaaagtcctagtggagatagagaagtgacatgacataggagaggatttggctggagttggggggagttcttgctttgctgccacgtcacagtgaaatcttggcaagccaccaaactgcacacatttttctatatctttaaaataaggaatatttgccataaccaaaagaataaagatatattcaacacattagttttctgtaaaacatgcatattataagcaaaacaacagcttctggcttctctcaaacccgtgaattctgaaagaaattttctccatctatgaagtagattacgtgatttcgtgggactttgattctaatgttttaataccaccactgctctggaatctaaggctaacctaactcttttaatatctttccttcttctaggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423417 - DNA, 1274 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggaggtccaggccctggaccctctctgcaactccccgatgttgcaggtggcacccaaataaatgaatcaagaaaagtaaatattttgaagaaggtgataaattgatgaagtcagtacaaacatatagatatacctacatagtagctaagtgaattgacagag

SEQ ID NO: 423418 - DNA, 722 bp, Homo sapiens
  misc_feature (12)..(12): n is a, c, g, or t
  misc_feature (15)..(15): n is a, c, g, or t
  misc_feature (18)..(18): n is a, c, g, or t
agctgaggtganctnggnacccgactacatacttccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggaagtatgtagtcgactacatacttccgggcctttgcccaggctgtttcctctgccggggactccttttccttccacccattctctcttgctaatttttacttattgttctgtgtctgtctttctctttctttctttcttttctttctttctttctttcttccttccttcctttctttcttcctcttctttctctctctccttctttcttttctttttctttctttcttttctttctttcttctttctttctttccttctttccttctttcttcggaagtatgtagt

SEQ ID NO: 423419 - DNA, 1172 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccatgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacg

SEQ ID NO: 423420 - DNA, 1670 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtacccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423421 - DNA, 1103 bp, Homo sapiens
cacactgaaatcaaactcacgtattcaaattttttttagattggcagaagcaggaagcacacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423422 - DNA, 1612 bp, Homo sapiens
  misc_feature (1526)..(1526): n is a, c, g, or t
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtaaaaaaaaaaacaaanaaacagtatggagatttgctcattgaactgagcttggtcattctcttaattaactcctgtccaaagtgatgatggaatttttagtc

SEQ ID NO: 423423 - DNA, 1565 bp, Homo sapiens
  misc_feature (1512)..(1515): n is a, c, g, or t
  misc_feature (1525)..(1525): n is a, c, g, or t
  misc_feature (1556)..(1556): n is a, c, g, or t
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgttnnnnaaaaaaaaanaatataaaaatttatattttataattttaantccttcggg

SEQ ID NO: 423424 - DNA, 2557 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgaaaaaaaaaaaaaaaaaaaaaaaaaaaaaaaaaaaaaaaaaaaaaaaaaaaaaaaaaaaaaaaaaaaaaaaaaaaaagaaagaaaagaaaaaaaaaagaaagaaaaaaaaaagagaaacaacaaaaaaaagaaaagaaaaaacaaaaacaacaccagacgagacgggagcgggggcggcgagcagactcaactcgataggtcggagagggacgcacaatgctcgcaccgcagatgttagttaggacggaaggaggcgcgcgggaggggagtcgcaagagcgtacgatcagagagagagagcaggcggcgcaggcggagagcaaacgcacgaggcggacgcaggacgcaggacgcagagtgagacgggagagacagagaagcagagagagagaaagaacgaaaagcagtgaggagagtgaaggcagcaaaagagcagaacgaggacggcacgagactgagaggagataagagagaaggaaagagagcagaaggaatagaacgagagagaagcgagcaaggagagcgaaggcagggggagaggcagagaagcagagagagagagaaggagggcggagagcagcggagcagacgcggagcaagggcagttagagagagataaaagtagataggcaagcacaggggaggaagggagtaggagtaacagtggacgggatgagaagaagtgaagggagtaaggagaggaggggaagaggaggggagagaggaggggagggggagagcttagaggagcagactgaggaggaagggagaggagatagagaaggaggggggagtagaagagagaggagggagaggacgagagagtagagagagagcaaggggaggacggaacgaggagagagagcgagaggagagcgcggagagcggaggagcgggagacaaggcgagagcaggagagagtgtagacgatggaaaggcaggggaaggggaagatagaggaaggaggcagcgaagagagcggagcgaggatgagaagcagtagggagagacagagagggagggagcgaagagaaggagagagacgtagagagatagaagagaaagatgccgaggcagaccggaagacgatgagaggagtgaagactg

SEQ ID NO: 423425 - DNA, 1521 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggaagtatgtagtcgactacatacttccgccattcggggctctgtagtcctttctctcaattttcttttaaagactacatacttccgaatttcgcgcacggcatcgatgaccaacagcacaaggatgacgatgagaaccacgaagaaggtgttgccataggacactaacaactccaccaggcgggacttgaaaatcttctgacaatctttaggagacatgagggaatgcga

SEQ ID NO: 423426 - DNA, 778 bp, Homo sapiens
ggaccctctccctactgtatcctactcctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatatatcttgtatgcattctttaaaccttacaggaaattagtgatgagttttaataattattaattgagtaaaggttggggcagtcttgagggtactatattgagatgacactctagcaatttatatagatagctactcttacaggaaatactgtaccaattatttaagcttgccctatactatttgaactttgtatgaattcaggaatcttgaatttctggcagagaccattctcaataaaaggtgactacaacataaactttattattcaaattagagcaaaggtttaattaaccagcattgactaaaatactttttgtgtgtatttatatacaaatataagtaatactatgtatggaataaccag

SEQ ID NO: 423427 - DNA, 1628 bp, Homo sapiens
ttgtgaagagtacactttgaaacgtatcatgttctacgcacatgtgtagggtattattatagttcaagagaaagagggaacccgctggtgtctgagaagaaacccgctggtgtctgagaagaaacggtgaagggtgcactacgaagggaatataaactaatcaaacattcttgaatggcaatgacagtcactaaagttgacacttcctgcagtcttttagtttagaaaccacacttcccgagacgtcccccatcccaacagggataaaatcctctagctcaactcaggtatatccccactattgggccagggagacctgcggatggcgagagcaggttctcttaggagggtgtggattgtgagcttgtgcgctggcgaggagcagaaggtcagggaggcaccgtagttaatgaatcaataaaccaaacagccgatcaatcacttcctgcagtccgagtccggcgagggctaatcgattggtccgggtattttgaaaggaaaaacggcggtggatatgttgtcaaacggaggggtgcaggagaggcggggccaggcctccaggtgacccctctggcttcctgggcctgcagaggcgccgaaacgtgcaggcgccggcgtccatgaggcgtggggcgcgccgggcgagtccctgcttgcaggaggcgcccgagaggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctagagatggcgcctggtggacagcaaaggctttgatgaatacatgaaggagctgagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggaagtatgtagtcgactacatacttccgggcctttgcccaggctgtttcctctgccggggactccttttccttccacccattctctcttgctaatttttacttattgttctgtgtctgtctttctctttctttctttcttttctttctttctttctttcttccttccttcctttctttcttcctcttctttctctctctccttctttcttttctttttctttctttcttttctttctttcttctttctttctttccttctttccttctttcttcggaagtatgtagt

SEQ ID NO: 423428 - DNA, 248 bp, Homo sapiens
acggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacc

SEQ ID NO: 423429 - DNA, 1691 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaa

SEQ ID NO: 423430 - DNA, 730 bp, Homo sapiens
  misc_feature (21)..(21): n is a, c, g, or t
  misc_feature (56)..(56): n is a, c, g, or t
  misc_feature (65)..(65): n is a, c, g, or t
  misc_feature (83)..(83): n is a, c, g, or t
  misc_feature (96)..(96): n is a, c, g, or t
gcacgcaaaaaagacccagcngggtagctcccggtccgcgcgacaaggaccacgcnccagcgccngcagcagcgacatctctntagccctcgtgcngaattcggcacgaggagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaatattgttttgactcctttttattcatacgtaaaattttggattaatttgtgaaaatgtaattataagctgagaccggtggctctcttcttaaaagcaccatattaaatcctggaaaactaa

SEQ ID NO: 423431 - DNA, 3995 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423432 - DNA, 4112 bp, Homo sapiens
  misc_feature (4060)..(4060): n is a, c, g, or t
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaaaaaaaaaaaaggacagctcgaggggcgggcaagaagacgttcaacgacgggctaccgcatagggngaggggagaggagactaggaagggatagggcgtgaggaaaggagatatagag

SEQ ID NO: 423433 - DNA, 3974 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtacctacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423434 - DNA, 3818 bp, Homo sapiens
cccccgggctgcaggagcttcggcacgagaatgcttacatccgtgtgtaatatcccgagaaattatggaaaattataacatagcattaaggtggacagccaaacagaagctttattcgagaacaggtgaatcagttgaatttgtgtgtaaacgggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatggaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423435 - DNA, 3803 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423436 - DNA, 5019 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423437 - DNA, 4961 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaatattgttttgactcctttttattcatacgtaaaattttggattaatttgtgaaaatgtaattataagctgagaccggtggctctcttcttaaaagcaccatattaaatcctggaaaactaa

SEQ ID NO: 423438 - DNA, 4965 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423439 - DNA, 5291 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaatattgttttgactcctttttattcatacgtaaaattttggattaatttgtgaaaatgtaattataagctgagaccggtggctctcttcttaaaagcaccatattaaatcctggaaaactaaaaaaaaaaaaaaaaaactcgagtttttttttttttttttttttttttttaaaacactctttacgccggcttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaacggggatgcttgcatgtgtaatcttactaagagctaataga

SEQ ID NO: 423440 - DNA, 5023 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423441 - DNA, 5255 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaatattgttttgactcctttttattcatacgtaaaattttggattaatttgtgaaaatgtaattataagctgagaccggtggctctcttcttaaaagcaccatattaaatcctggaaaactaaaaaaaaaaaaaaaaaactcgagtttttttttttttttttttttttttttaaaacactctttacgccggcttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaacggggatgcttgcatgtgtaatcttactaagagctaataga

SEQ ID NO: 423442 - DNA, 5041 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacataacatagcattaaggtggacagccaaacagaagctttattcgagaacaaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctacta

SEQ ID NO: 423443 - DNA, 5086 bp, Homo sapiens
  misc_feature (5034)..(5034): n is a, c, g, or t
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaaaaaaaaaaaaggacagctcgaggggcgggcaagaagacgttcaacgacgggctaccgcatagggngaggggagaggagactaggaagggatagggcgtgaggaaaggagatatagag

SEQ ID NO: 423444 - DNA, 4852 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaacattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaatattgttttgactcctttttattcatacgtaaaattttggattaatttgtgaaaatgtaattataagctgagaccggtggctctcttcttaaaagcaccatattaaatcctggaaaactaa

SEQ ID NO: 423445 - DNA, 3603 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattcccgttgtcagtatatgctccagcttcatcagttgagtaccaatgccagaacttgtatcaacttgagggtaacaagcgaataacatgtagaaatggacaatggtcagaaccaccaaaatgcttactggctacatatccgggtgaatattccgaggaattttgggaaattattaccttgcttta

SEQ ID NO: 423446 - DNA, 3954 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattcttagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttatgaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagttggctatgtgacatttataattagagaattatgtatagactggtattattctcagttagtgttgcagatcatgatcattatctattagatct

SEQ ID NO: 423447 - DNA, 3042 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatcta

SEQ ID NO: 423448 - DNA, 2408 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaagaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaggggactccatttaggcagggtgtcacttcttatacccaacagggaactccatttagccgg

SEQ ID NO: 423449 - DNA, 1173 bp, Homo sapiens
ggcagtgcacagctggtttgcgtgcgggtcggagactacaggatcccggtacttacccagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttgactcctttttattcatacgtaaaattttggattaatttgtgaaaatgtaattataagctgagaccggtggctctcttcttaaaagcaccatattaaatcctggaaaactaa

SEQ ID NO: 423450 - DNA, 1839 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaattccttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaa

SEQ ID NO: 423451 - DNA, 981 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatc

SEQ ID NO: 423452 - DNA, 1075 bp, Homo sapiens
gggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaagaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaggggactccatttaggcagggtgtcacttcttatacccaacagggaactccatttagccgg

SEQ ID NO: 423453 - DNA, 603 bp, Homo sapiens
ggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaaga

SEQ ID NO: 423454 - DNA, 388 bp, Homo sapiens
cttcatcagttgagtaccaatgccagaacttgtatcaacttgagggtaacaagcgaataacatgtagaaatggacaatggtcagaaccaccaaaatgcttactacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctact

SEQ ID NO: 423455 - DNA, 1499 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaa

SEQ ID NO: 423456 - DNA, 733 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423457 - DNA, 743 bp, Homo sapiens
  misc_feature (116)..(116): n is a, c, g, or t
tttgtggaatgttacgggatacaatttcccccaggaacagcttatgcaatgtacggcaagtcttaaaacgccccactataggaaagctggaccgcctcaggggacgggtcgaattnccgggtcgaaccacgcgtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423458 - DNA, 1280 bp, Homo sapiens
  misc_feature (116)..(116): n is a, c, g, or t
  misc_feature (1155)..(1155): n is a, c, g, or t
tttgtggaatgttacgggatacaatttcccccaggaacagcttatgcaatgtacggcaagtcttaaaacgccccactataggaaagctggaccgcctcaggggacgggtcgaattnccgggtcgaaccacgcgtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaaaacaaaaaattccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaggggtcattgtcattcgaagatgtggctgtgggcttcaccagggaggagtggcagtttttggaccagtcttaagaggtcttgtacaaggaagtaatgttggagaactacattaacctagtatcaatagggtatcgaggcaccaagccagattcgctctttaaagttgagcaaggagacccccaaggatagcataagagcaggccacagtcaaatttgtcagggtttcattatgagaagaccctccanattgaggaatcaggaagcttgtagattacacctattgtaatttgattaccgttgaaaccaaattttagaacacagttgccattagaccttaactttaacaccacccttataaaggagcaaataat

SEQ ID NO: 423459 - DNA, 362 bp, Homo sapiens
ataaaattaattaagttggcactggacttccggtggtcagtcatgtgtgtcatctgtcacgtttttcgggctctggtggaaatggatctgtctgtcttctctcataggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423460 - DNA, 659 bp, Homo sapiens
  misc_feature (566)..(566): n is a, c, g, or t
  misc_feature (577)..(577): n is a, c, g, or t
agtgggcatatcatctgaggtcaggagttcaagaccagcctggccaacatggcaaaactccgtctttatgaaaaatacaaaaattagccaggcatggtggcaggcgcctgtaatcccagctaattgggaggctgaggctggagaatcccttgaatctaggaggcagaggttgcagtgagctgagatcgtgccattgcactccagcctgggtgacaagagtaaaactctgtctcaaaaaaaaaaaaaaaaaactcgctcgtgccgaattcggcacgagcttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacnaaaataaaaantaaaatatttatatatataaaaataaaaggggggcccggtccccaattgccctatgggagccttttcaattaactggcctcg

SEQ ID NO: 423461 - DNA, 954 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaacaaagaaaagaaaagaaaaaaaaaaaaataatagaagaaagaaaaaatgaggaggaaaaaaaagaagaggaaaaagaggaaatagtaaaagatgtaaagaaaggaaaggagaataaaaaaaccttaggggggggcccggaacccaatatccccatttgagggcggaattacaaattatggggccgcttgtttacaccttggaatctggaaggagaaa

SEQ ID NO: 423462 - DNA, 1267 bp, Homo sapiens
  misc_feature (734)..(734): n is a, c, g, or t
  misc_feature (760)..(760): n is a, c, g, or t
  misc_feature (807)..(807): n is a, c, g, or t
  misc_feature (810)..(810): n is a, c, g, or t
  misc_feature (818)..(818): n is a, c, g, or t
  misc_feature (866)..(866): n is a, c, g, or t
  misc_feature (888)..(888): n is a, c, g, or t
  misc_feature (895)..(895): n is a, c, g, or t
  misc_feature (936)..(936): n is a, c, g, or t
  misc_feature (987)..(987): n is a, c, g, or t
  misc_feature (1005)..(1005): n is a, c, g, or t
  misc_feature (1013)..(1013): n is a, c, g, or t
  misc_feature (1049)..(1049): n is a, c, g, or t
  misc_feature (1055)..(1055): n is a, c, g, or t
  misc_feature (1061)..(1061): n is a, c, g, or t
  misc_feature (1076)..(1076): n is a, c, g, or t
  misc_feature (1091)..(1092): n is a, c, g, or t
  misc_feature (1111)..(1113): n is a, c, g, or t
  misc_feature (1117)..(1118): n is a, c, g, or t
  misc_feature (1124)..(1124): n is a, c, g, or t
  misc_feature (1126)..(1126): n is a, c, g, or t
  misc_feature (1128)..(1128): n is a, c, g, or t
  misc_feature (1132)..(1132): n is a, c, g, or t
  misc_feature (1135)..(1135): n is a, c, g, or t
  misc_feature (1143)..(1143): n is a, c, g, or t
  misc_feature (1148)..(1148): n is a, c, g, or t
  misc_feature (1150)..(1150): n is a, c, g, or t
  misc_feature (1155)..(1155): n is a, c, g, or t
  misc_feature (1171)..(1172): n is a, c, g, or t
  misc_feature (1177)..(1177): n is a, c, g, or t
  misc_feature (1183)..(1183): n is a, c, g, or t
  misc_feature (1190)..(1190): n is a, c, g, or t
  misc_feature (1192)..(1192): n is a, c, g, or t
  misc_feature (1196)..(1196): n is a, c, g, or t
  misc_feature (1198)..(1198): n is a, c, g, or t
  misc_feature (1210)..(1210): n is a, c, g, or t
  misc_feature (1213)..(1215): n is a, c, g, or t
  misc_feature (1224)..(1225): n is a, c, g, or t
  misc_feature (1234)..(1235): n is a, c, g, or t
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacnaaaaaaaaaaaaaactcgggttgggnctttgtttttttaccttgacttttaaaaaaaaaaaaaaaactcgagnaancttcttanggaaaactccaattggctttttccccaacttacaaaaaaataatctgntttttaaaaagaatgggttttnattttgnaaggggaaaggggaaaaaatcataaggacctatccggtgcntcatatttttgcttttaagagaaactcaaatccccgaattttcctggggcnggtgttatatttaaaacntttaaaanttgtttaccaaaaaggaccaggatttaaacttttgngggttnttgttnacagggaaactttanaagcctgtttttttnnagggcccaaataaccctgnnnttannaaagcngncntttnttntccggggntgttnangggcncttttgtgacaagaannccctnctaagntttactncncaantnacccgttttttngtnnngaaaccccnnccttttttnnaccaaacttctttgggttggacattaaaccca

SEQ ID NO: 423463 - DNA, 1216 bp, Homo sapiens
  misc_feature (756)..(756): n is a, c, g, or t
  misc_feature (759)..(759): n is a, c, g, or t
  misc_feature (767)..(767): n is a, c, g, or t
  misc_feature (815)..(815): n is a, c, g, or t
  misc_feature (837)..(837): n is a, c, g, or t
  misc_feature (844)..(844): n is a, c, g, or t
  misc_feature (885)..(885): n is a, c, g, or t
  misc_feature (936)..(936): n is a, c, g, or t
  misc_feature (954)..(954): n is a, c, g, or t
  misc_feature (962)..(962): n is a, c, g, or t
  misc_feature (998)..(998): n is a, c, g, or t
  misc_feature (1004)..(1004): n is a, c, g, or t
  misc_feature (1010)..(1010): n is a, c, g, or t
  misc_feature (1025)..(1025): n is a, c, g, or t
  misc_feature (1040)..(1041): n is a, c, g, or t
  misc_feature (1060)..(1062): n is a, c, g, or t
  misc_feature (1066)..(1067): n is a, c, g, or t
  misc_feature (1073)..(1073): n is a, c, g, or t
  misc_feature (1075)..(1075): n is a, c, g, or t
  misc_feature (1077)..(1077): n is a, c, g, or t
  misc_feature (1081)..(1081): n is a, c, g, or t
  misc_feature (1084)..(1084): n is a, c, g, or t
  misc_feature (1092)..(1092): n is a, c, g, or t
  misc_feature (1097)..(1097): n is a, c, g, or t
  misc_feature (1099)..(1099): n is a, c, g, or t
  misc_feature (1104)..(1104): n is a, c, g, or t
  misc_feature (1120)..(1121): n is a, c, g, or t
  misc_feature (1126)..(1126): n is a, c, g, or t
  misc_feature (1132)..(1132): n is a, c, g, or t
  misc_feature (1139)..(1139): n is a, c, g, or t
  misc_feature (1141)..(1141): n is a, c, g, or t
  misc_feature (1145)..(1145): n is a, c, g, or t
  misc_feature (1147)..(1147): n is a, c, g, or t
  misc_feature (1159)..(1159): n is a, c, g, or t
  misc_feature (1162)..(1164): n is a, c, g, or t
  misc_feature (1173)..(1174): n is a, c, g, or t
  misc_feature (1183)..(1184): n is a, c, g, or t
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaaaaaaaaaaaaaactcgagnaancttcttanggaaaactccaattggctttttccccaacttacaaaaaaataatctgntttttaaaaagaatgggttttnattttgnaaggggaaaggggaaaaaatcataaggacctatccggtgcntcatatttttgcttttaagagaaactcaaatccccgaattttcctggggcnggtgttatatttaaaacntttaaaanttgtttaccaaaaaggaccaggatttaaacttttgngggttnttgttnacagggaaactttanaagcctgtttttttnnagggcccaaataaccctgnnnttannaaagcngncntttnttntccggggntgttnangggcncttttgtgacaagaannccctnctaagntttactncncaantnacccgttttttngtnnngaaaccccnnccttttttnnaccaaacttctttgggttggacattaaaccca

SEQ ID NO: 423464 - DNA, 1221 bp, Homo sapiens
  misc_feature (756)..(756): n is a, c, g, or t
  misc_feature (759)..(759): n is a, c, g, or t
  misc_feature (767)..(767): n is a, c, g, or t
  misc_feature (815)..(815): n is a, c, g, or t
  misc_feature (837)..(837): n is a, c, g, or t
  misc_feature (844)..(844): n is a, c, g, or t
  misc_feature (885)..(885): n is a, c, g, or t
  misc_feature (936)..(936): n is a, c, g, or t
  misc_feature (954)..(954): n is a, c, g, or t
  misc_feature (962)..(962): n is a, c, g, or t
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaaaaaaaaaaaaaactcgagnaancttcttanggaaaactccaattggctttttccccaacttacaaaaaaataatctgntttttaaaaagaatgggttttnattttgnaaggggaaaggggaaaaaatcataaggacctatccggtgcntcatatttttgcttttaagagaaactcaaatccccgaattttcctggggcnggtgttatatttaaaacntttaaaanttgtttaccaaaaaggaccaggatttaaactttatggaggttttggtttacaagggaaaatttaaaaagctttctttttttaaggcccccaataaccccgggttttaaaaaaacggggttttttttttccggggggtgtttaaggggccttttttggaaaaaaagaccccctttttttttttttctccccctttccccctttttttttggtggagtaaataccccccccccctttttttataccctcttttttggtggt

SEQ ID NO: 423465 - DNA, 814 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccatactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttc

SEQ ID NO: 423466 - DNA, 700 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423467 - DNA, 1848 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccgggttgttttggttttggtttttgcttttggcattccaggaaatgcacagttttactcagtgtaccacagaaatgtcctaaggaaggtgatgaatgaccaaaggttccctttcctattatacaagaaaaaattcacaacactctgagaagcaaatttctttttgactttgatgaaaatccacttagtaacatgacttgaacttacatgaaactactcatagtctattcattccactttatatgaatattgatgtatctgctgttgaaataatagtttatgaggcagccctccagaccccacgtagagtgtatgtaacaagagatgcaccattttatttctcgaaaacccgtaacattcttcattccaaaacacatctggcttctcggaggtctggacaagtgattcttggcaacacatacctatagagacaataaaatcaaagtaataatggcaacacaatagataacatttaccaagcatacaccatgtggcagacacaattataagtgttttccatatttaacctacttaatcctcaggaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcatttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacatta

SEQ ID NO: 423468 - DNA, 1794 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccgggttgttttggttttggtttttgcttttggcattccaggaaatgcacagttttactcagtgtaccacagaaatgtcctaaggaaggtgatgaatgaccaaaggttccctttcctattatacaagaaaaaattcacaacactctgagaagcaaatttctttttgactttgatgcattccactttatatgaatattgatgtatctgctgttgaaataatagtttatgaggcagccctccagaccccacgtagagtgtatgtaacaagagatgcaccattttatttctcgaaaacccgtaacattcttcattccaaaacacatctggcttctcggaggtctggacaagtgattcttggcaacacatacctatagagacaataaaatcaaagtaataatggcaacacaatagataacatttaccaagcatacaccatgtggcagacacaattataagtgttttccatatttaacctacttaatcctcaggaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcatttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacatta

SEQ ID NO: 423469 - DNA, 590 bp, Homo sapiens
  misc_feature (13)..(14): n is a, c, g, or t
  misc_feature (18)..(19): n is a, c, g, or t
  misc_feature (50)..(50): n is a, c, g, or t
ggagtggcggggnncganntggggggggggggggttcggacgttgtgtgnggggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctggggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423470 - DNA, 684 bp, Homo sapiens
  misc_feature (116)..(116): n is a, c, g, or t
tttgtggaatgttacgggatacaatttcccccaggaacagcttatgcaatgtacggcaagtcttaaaacgccccactataggaaagctggaccgcctcaggggacgggtcgaattnccgggtcgaaccacgcgtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctggggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcac

SEQ ID NO: 423471 - DNA, 1799 bp, Homo sapiens
  misc_feature (116)..(116): n is a, c, g, or t
tttgtggaatgttacgggatacaatttcccccaggaacagcttatgcaatgtacggcaagtcttaaaacgccccactataggaaagctggaccgcctcaggggacgggtcgaattnccgggtcgaaccacgcgtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctggggatatacaaagtggaaatagacaccaaatcttactggaaggcacttggcatctccccattccatgagcatgcagaggtggtattcacagccaacgactccgggttgttttggttttggtttttgcttttggcattccaggaaatgcacagttttactcagtgtaccacagaaatgtcctaaggaaggtgatgaatgaccaaaggttccctttcctattatacaagaaaaaattcacaacactctgagaagcaaatttctttttgactttgatgaaaatccacttagtaacatgacttgaacttacatgaaactactcatagtctattcattccactttatatgaatattgatgtatctgctgttgaaataatagtttatgaggcagccctccagaccccacgtagagtgtatgtaacaagagatgcaccattttatttctcgaaaacccgtaacattcttcattccaaaacacatctggcttctcggaggtctggacaagtgattcttggcaacacatacctatagagacaataaaatcaaagtaataatggcaacacaatagataacatttaccaagcatacaccatgtggcagacacaattataagtgttttccatatttaacctacttaatcctcaggaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcatttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacatta

SEQ ID NO: 423472 - DNA, 929 bp, Homo sapiens
  misc_feature (116)..(116): n is a, c, g, or t
tttgtggaatgttacgggatacaatttcccccaggaacagcttatgcaatgtacggcaagtcttaaaacgccccactataggaaagctggaccgcctcaggggacgggtcgaattnccgggtcgaaccacgcgtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggtaagttgccaaagaaccctcccacaggacttggttttatcttcccgtttgcccctcacttggtagagagaggctcacatcatctgctaaagaatttacaagtagattgaaaaacgtaggcagaggtcaagtatgccctctgaaggatgccctctttttgttttgcttagctaggaagtgaccaggaacctgagcatcatttaggggcagacagtagagaaaagaaggaatcagaactcctctcctctagctgtggtttgcaacccttttgggtcacagaacactttatgtaggtgatgaaaagtaaacattctatgcccagaaaaaatgcacagatacacacacatacaaaatcatatatgtgattttaggagtttcacagattccctggtgtccctgggtaacaccaaagctaagtgtccttgtcttagaattttaggaaaaggtataatgtgtattaacccattaacaaaaggaaaggaattcagaaatattattaaccaggcatctgtctgtagttaatatggatcacccaaaacccaaggcttttgcctaatgaacactttggggcacctac

SEQ ID NO: 423473 - DNA, 1270 bp, Homo sapiens
  misc_feature (1145)..(1145): n is a, c, g, or t
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaaaacaaaaaattccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaggggtcattgtcattcgaagatgtggctgtgggcttcaccagggaggagtggcagtttttggaccagtcttaagaggtcttgtacaaggaagtaatgttggagaactacattaacctagtatcaatagggtatcgaggcaccaagccagattcgctctttaaagttgagcaaggagacccccaaggatagcataagagcaggccacagtcaaatttgtcagggtttcattatgagaagaccctccanattgaggaatcaggaagcttgtagattacacctattgtaatttgattaccgttgaaaccaaattttagaacacagttgccattagaccttaactttaacaccacccttataaaggagcaaataat

SEQ ID NO: 423474 - DNA, 868 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttc

SEQ ID NO: 423475 - DNA, 759 bp, Homo sapiens
ctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacaaaaaagaaaaaattctccagcgctg

SEQ ID NO: 423476 - DNA, 2842 bp, Homo sapiens
  misc_feature (893)..(893): n is a, c, g, or t
  misc_feature (1157)..(1157): n is a, c, g, or t
  misc_feature (1218)..(1218): n is a, c, g, or t
  misc_feature (2195)..(2195): n is a, c, g, or t
gaaaagatctccctgcacactgtagtcactgtatttgtacagcaagggacttgttccccaagcctggagcttttggaactgaatggagcccagaggcaagagtagtgaaatgaggctgacctttgcttctggttttgcttgctacttgccagtatgtgggttccctggaggaacacacaggtgtcttggctttgccactgggcattttgggtgatttcgttaactttgcctgttttgaccagaagagagcctgatcgtgataggaggaggcgggggactgacggggttatacaatcttcacatatatatacactcagtcccatgccttgagtctagaggctggggagagggcccagctgcacgttggttgaggccagcagtacatggcccttgaggctatgctgatagcaacttgtggcacactttgtacttcatactgtgaggaacatgaaataagccagagccaggcctgatcttgaaagaaccctctgtcaagtgggaaggcctgttgcagacatgcatcaactggcccagctggcttatccatggctgtccctgggcctcctgtgaatccagaggaggctgctccagcattgataaggctgggatggggcaggttccacaaggagggaaagctcaccccagtgtaaaaggaaggagtgggggataagtctatctcatgaataacctgagcaaaggcccaaaagagtgtggctgatagattgggggaactgagagtagtctgggggtggggggcacctagaggacagggcacctgtgagagagtgagggagatgagactggaaagatggaccagggcaaaccacgaaaggccttgaagaccatgctaaatcatttgaactttgttacaagctttggaaaccttttaaaanccatggaatttaaatgtttgagatgaggggagtaacattatggaaagatattttggctgggtgtggtagctcatgcctgtaatcctagcactttggaaagccgaggcaggaggatcacttgagctcaggagttcaagaccaacctgggcaacatagtgagacctcgtcactatttaaaaaaataaaaaataaataataataaagaaagataatttgagtgactgggaaggggtgaactgaaagagagattaattaaagacagtnaagagcaatttgcaaaggtttagttgaaagaaattgaagcccacagttttgtaggccaagncctggcccttctgcgtgcttcccccatgcccacgtgcacttggaggctggcctctctcctcctcctttcaggcctgcattgcaagtgtgggggcgactggccacgtcttccatttcggtgagggcacaccagaggagccagggtttctagtgatgcgtcaccataacagcaagtctcatttcatgaagtctcactgcatcatcaaatgcttaccccttatccctaaactggcaaaacttactcttagaaaaaagttacatacaatttaacattggaaaagaaaatcttatatttgatttttttgcattagaaaatattttgacaaccctttttaaaataatttttatcttcatcaaagtagcctatggtttaaatgtcaaaaagaactaaaaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcactgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtctttttttttaagttgaccccaaaatgtgtttttacattttactggtgtgtgaaatctagaaatcaggaaacaagtgacctaggctttaaaantaaataaataaataaaataagcttgactatgaaggaaggcacatagacggagcagtggccagaagacaggataggagagggacaagatttttcttttcaagctgagagagacttaagcataggcagaaagagggttgaagaaggcagtgtagccaaatatcaaagaaaaataatggtggcctgttctgagagggagaagacaggccggggacattcacacctgacgggcctgtgcttcctagatgcggaggcaggcagggccctctcacggcaagctgggaaggccctaccctaaggcatgtttccacaatttctctaaacttttcttttctgatagtctgttttaaaaaaatcaaaatggtcagggttggtggttcacgcctgtaatcccagctattcaggaggccaaggtgggaggatcacttgaggccacgagttcaagaccagcctgggcaacacagcaagactccatctcaaaaaaaaaaaaaaattatattagccaggcatggtggcacacgcctgtggttccagctactcaggagaccgaggtgagaggatcacttgaatccaggagttcaaggctgcagtgagctgtggtcacgccactgcactccagcctaggctacagagccagaccctgtctctta

SEQ ID NO: 423477 - DNA, 486 bp, Homo sapiens
  misc_feature (26)..(26): n is a, c, g, or t
  misc_feature (73)..(73): n is a, c, g, or t
  misc_feature (82)..(82): n is a, c, g, or t
  misc_feature (112)..(112): n is a, c, g, or t
ctgttttaaaaaaaatcaaaaggtcnaggttggtggttcacgcctgtaatcccagctattcgggaggcccaangtgggaggntcacttgaggcccacgaagttcaaaaccanccctgggaaggccctaccctaaggcatgtttccacaatttctctaaacttttcttttctgatagtctgttttaaaaaaatcaaaatggtcagggttggtggttcacgcctgtaatcccagctattcaggaggccaaggtgggaggatcacttgaggccacgagttcaagaccagcctgggcaacacagcaagactccatctcaaaaaaaaaaaaaaattatattagccaggcatggtggcacacgcctgtggttccagctactcaggagaccgaggtgagaggatcacttgaatccaggagttcaaggctgcagtgagctgtggtcacgccactgcactccagcctaggctacagagccagaccctgtctctta

SEQ ID NO: 423478 - DNA, 1376 bp, Homo sapiens
ctttgtctgacttacatcctctcaaccctctcccaggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccaggtgagttcatgcccagggcctgcaccaccaatctgagccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaagtctggcctttccaatccccatctccttgccccccccttgccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggt

SEQ ID NO: 423479 - DNA, 2753 bp, Homo sapiens
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactctttgtggggggcagcccctatcctgggttccagcatggacacaggggtagcctggggcttatagagaaacagctggtttcccctaccctttcccggggaagaccccacgattggcctctagtcagcaaatggagataacagagtctggcctttccaatccccatctccttgccccccccttgccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggt

SEQ ID NO: 423480 - DNA, 3218 bp, Homo sapiens
  misc_feature (2761)..(2761): n is a, c, g, or t
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactctttgtggggggcagcccctatcctgggttccagcatggacacaggggtagcctggggcttatagagaaacagctggtttcccctaccctttcccggggaagaccccacgattggcctctagtcagcaaatggagataacagagtctggcctttccaatccccatctccttgccccccccttgccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggtaaaaaaantgaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaagggggggggggggggcgacagaatatatcactagaggggggaaaaaaaaaaaacagcgcccaatgtaaaagaaagagaggaaaaaaaaaagagaaaaaaagaaaagaagaagagaggcgtaaaaaaaggcggggcggagggagtgggacgtggggggttgggggtgggggaacgcgggggggtgaggtgtgggggtacaccacaaaagaagggaggacgaagagaaaaagaaaacaagagagtgtatgagggatcacacgaaggagatcggagagagagagaatgaggtgaggagagattatcaggatattaacggggcaacaaggaagagagggcggagggg

SEQ ID NO: 423481 - DNA, 2207 bp, Homo sapiens
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcagtttgcagtgcccagccaccccgtcgggtggagc

SEQ ID NO: 423482 - DNA, 1847 bp, Homo sapiens
  misc_feature (1742)..(1742): n is a, c, g, or t
  misc_feature (1784)..(1784): n is a, c, g, or t
  misc_feature (1804)..(1804): n is a, c, g, or t
  misc_feature (1811)..(1811): n is a, c, g, or t
  misc_feature (1838)..(1838): n is a, c, g, or t
  misc_feature (1842)..(1842): n is a, c, g, or t
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctccngaagccaagattgaaccgggggtggggaacccccggggttangtaaaggggacccgggccgncccaaantggggttaaaggggggggtgccccctngggntggga

SEQ ID NO: 423483 - DNA, 284 bp, Homo sapiens
tgctgggattacaggcatgatccaggcatgatccacagacctgcccctacccatctttgatgcagtcagaggccctgcctcttgacatgccaatcagaggcctagttgcgtaagcaaccagtcctagctctgccagtgaaaacctgaaagggtcgaaggccgctttccacaggccaatcaggagcctagttccctaagcagccaatcagaggtcggctgtcgcctctttctatgacctaccctgtctcccttcagaatccccgcctgccccgacaatctccaga

SEQ ID NO: 423484 - DNA, 2227 bp, Homo sapiens
  misc_feature (2215)..(2216): n is a, c, g, or t
  misc_feature (2226)..(2227): n is a, c, g, or t
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttgggcgtacggggaggggatnntctagttcgnn

SEQ ID NO: 423485 - DNA, 1867 bp, Homo sapiens
cgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggcgttggatgcagtcaccccgcggcgttggatgcagtcaccccgcggcgttggatgcagtcgggta

SEQ ID NO: 423486 - DNA, 1046 bp, Homo sapiens
  misc_feature (1)..(3): n is a, c, g, or t
nnnctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttact

SEQ ID NO: 423487 - DNA, 3470 bp, Homo sapiens
  misc_feature (1)..(3): n is a, c, g, or t
nnnctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatatttgccaaaaatacagatattttatttaatgaatcttaagctacagcaaatagatagatattataccactgttaaattggttttagatgcagtaaataagatatatgatagatagtgaagttggtagattaaatattttccttaaatcctctataatttccatctataataaaagtccccctgtaatcccaacactttgagaggccgaggcgggcagatcatgaggtcaggagttcaagaccagcctgaccaacatggtgaa

SEQ ID NO: 423488 - DNA, 3417 bp, Homo sapiens
  misc_feature (1)..(3): n is a, c, g, or t
nnnctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatatttgccaaaaatacagatattttatttaatgaatcttaagctacagcaaatagatagatattataccactgttaaattggttttagatgcagtaaataagatatatgatagatagtgaagttggtagattaaatattttccttaaatcctctataatttccatctataataaaagtccccctgtaatcccaacactttgagaggccgaggcgggcagatcatgaggtcaggagttcaagaccagcctgaccaacatggtgaa

SEQ ID NO: 423489 - DNA, 3416 bp, Homo sapiens
  misc_feature (1)..(3): n is a, c, g, or t
nnnctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcactatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatatttgccaaaaatacagatattttatttaatgaatcttaagctacagcaaatagatagatattataccactgttaaattggttttagatgcagtaaataagatatatgatagatagtgaagttggtagattaaatattttccttaaatcctctataatttccatctataataaaagtccccctgtaatcccaacactttgagaggccgaggcgggcagatcatgaggtcaggagttcaagaccagcctgaccaacatggtgaa

SEQ ID NO: 423490 - DNA, 3416 bp, Homo sapiens
  misc_feature (1)..(3): n is a, c, g, or t
nnnctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattattataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatatttgccaaaaatacagatattttatttaatgaatcttaagctacagcaaatagatagatattataccactgttaaattggttttagatgcagtaaataagatatatgatagatagtgaagttggtagattaaatattttccttaaatcctctataatttccatctataataaaagtccccctgtaatcccaacactttgagaggccgaggcgggcagatcatgaggtcaggagttcaagaccagcctgaccaacatggtgaa

SEQ ID NO: 423491 - DNA, 883 bp, Homo sapiens
  misc_feature (810)..(810): n is a, c, g, or t
  misc_feature (820)..(820): n is a, c, g, or t
  misc_feature (860)..(860): n is a, c, g, or t
ggttcagctttgttcttactttgtttgtgttacactggtatccagtcatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatcttacacttttagtggaggctnctttaacggnaaaggacccatggcaccatcattcaggaggacttgagganggggggagaggggccttgaggac

SEQ ID NO: 423492 - DNA, 525 bp, Homo sapiens
gcctgtgggattcacaatttacacaggcctgagtgagaatgcaggtgcgctgaaggagcaggcaatagtgaagagtcaaggtttgggaggggaaccagagaccccagacttcagaactgcagcttttggggtcaacacaacatcccagaacatcaagacaccaagacatatcagctaggaccctgcagtaggacatcggtgtccagatgagaccagaagcaacccagtagaagccaggggacagtgtgtggaccacagaattcatgcttgatgccatcaagggcctttgcctcagacatgcatacggcaggagtgtgagatctatggagtgggctcagctcatggagcaaggaggacggcaggggctccaatgatgatgtctgcgtaagaattcccatttaagatctttccaagcacaagagtcatggcccaatggcagagtgtcctatgcccacgaataaatcaaggatgaagaagacatttttggaaccagcatagtttctggtaggatctttgccactactt

SEQ ID NO: 423493 - DNA, 1836 bp, Homo sapiens
ggttcagctttgttcttactttgtttgtgttacactggtatccagtcatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaagtgt

SEQ ID NO: 423494 - DNA, 2268 bp, Homo sapiens
ggttcagctttgttcttactttgtttgtgttacactggtatccagtcatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaagtagaagttgatacacatttgaagttgcccatcccactaccaccaaatgatgtggaagagaatgagtcccctgtgacctagtgacgagaatgaagtaaatcctgtctcaaaagaagaaaatccacttccaagggacaaggtctcactctgtcgcccaagctggagcacagtggcacaataatagttcactgcagccttgaagtcctgggctcaagtgattctcctgcctcagcctcttgagtagctaggactacagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaagtgt

SEQ ID NO: 423495 - DNA, 1271 bp, Homo sapiens
ggttcagctttgttcttactttgtttgtgttacactggtatccagtcatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggttaaggctcacggagggttaaggctcccggagggttaaggctcccggagtattaaggcgcccggagggttaaggctcctaaggatcctctagag

SEQ ID NO: 423496 - DNA, 2019 bp, Homo sapiens
gatagatgagctgtatgagtcaggagttctgctctccaggtctgaggctgttcattgcctgggtttgtccagcgggcctgaagccatggagagcataatatttagaggtggcgaacccgacaccaccctgcttgcattctttgctccaggccttctgacctagttgtccttttcctgtaccccatgcttgctccctgagccctacgcttgctgttctccagattgaggctttctcctcttgcttcatactcccctccctcagcccactatgcactatgtcaggccaactggtcttactctgcaggagagtctgagattcactgttgcttcctgtggggaggcttttctgagcccccaggcctggtgctgtgtgctcccgtggcagcccctgcttctcctgtacaccacatattgccaacttgcttctgactttcccctactgagctacattctccatgagttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagggcctttgcctcagacatgcatacggcaggagtgtgagatctatggagtgggctcagctcatggagcaaggaggacggcaggggctccaatgatgatgtctgcccattttactgagaagcatgacatctatcaacttcccagatccctgcgagaatggattgaggagtctgagctctggaaatcaaagtggctaagcgagcaccgttattgctgttaagaaaacctgcaatgcgcgagttgaaactttctaagtttggatctgcttttgtctgacctctgcctggatagtaaggcagctgagtgattcacaggcacagaaatgcaccacgttgctattcccagaccctgccacaaaagactgttgaattcccaatgtctccatgctcacttcctgtcctcactgtgactatgaggcactttgaagatttaacacattatagaaacacacagcatcatgtttataataagtctacattctgaatcaaaataatggtttagtcttctcagatgagagggaatatctggggctaaatgagggtaagtcacgtacttttctatgtgcaggcaaaactgattttgttctgagtgagctgcagcctgcagcctcttttcaaagctgactcctagggggtttggccagggctgctttttgcatgaattgttgacattcaaacacctttatctctgatgctgctctacagcttaatgtgatatttctgtccaaactcaacttttgatgagaagaaaagatttttaatccaaaatatgcacacaactccccagccccagggaaaggacttctttgtcttagtgagagcacttctttgagtgctctttgggtggctctgtagctcacttgcagcatgggattgagaaaggaaaagtggagcccagggcaggcagggggttttccagctcctctaaagaggttgcttaccagtgggaccttactgttttgcttggaagtttgagagttaccagttcatcaggatatccacttttttttttttgagatggagtcttgctctgtcacccaggctggagtgcagtggcacaatctcagctcactgcaacctctgcctctggggttcaagtaattctcctgcctcagcctcccctgtagatgggattacaggcatgagccgccaggcctggctaatttttgtaattttagtagatatggggtttcactatgttggccaggctggtctcaaactcctgacctcatgatccacccacctcagcctcccaaagtggtaggattacagacgcgagccatcacaccagctgatatccacttttaaatgccagtgctgtacttggcataaagtagaccatgaataaatgtttgttgaataaatgaatgaatgattaaagcccaaattcca

SEQ ID NO: 423497 - DNA, 1641 bp, Homo sapiens
gatagatgagctgtatgagtcaggagttctgctctccaggtctgaggctgttcattgcctgggtttgtccagcgggcctgaagccatggagagcataatatttagaggtggcgaacccgacaccaccctgcttgcattctttgctccaggccttctgacctagttgtccttttcctgtaccccatgcttgctccctgagccctacgcttgctgttctccagattgaggctttctcctcttgcttcatactcccctccctcagcccactatgcactatgtcaggccaactggtcttactctgcaggagagtctgagattcactgttgcttcctgtggggaggcttttctgagcccccaggcctggtgctgtgtgctcccgtggcagcccctgcttctcctgtacaccacatattgccaacttgcttctgactttcccctactgagctacattctccatgagttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagggcctttgcctcagacatgcatacggcaggagtgtgagatctatggagtgggctcagctcatggagcaaggaggacggcaggggctccaatgatgatgtctgcccattttactgagaagcatgacatctatcaacttcccagatccctgcgagaatggattgaggagtctgagctctggaaatcaaagtggctaagcgagcaccgttattgctgttaagaaaacctgcaatgcgcgagttgaaactttctaagtttggatctgcttttgtctgacctctgcctggatagtaaggcagctgagtgattcacaggcacagaaatgcaccacgttgctattcccagaccctgccacaaaagactgttgaattcccaatgtctccatgctcacttcctgtcctcactgtgactatgaggcactttgaagatttaacacattatagaaacacacagcatcatgtttataataagtctacattctgaatcaaaataatggtttagtcttctcagatgagagggaatatctggggctaaatgagggagggatctccccaacctttctgtcttcgagctggccatgaaggaattctctgatctaccttgtctgactgtggattatgagacctccatttcagaaggggtcccaaaccctggaggaaggaatgttgctcagagagatcaagaagaatcttaacagacaggcctcgctaggtttccctgctcagtctattaatattaaatcatcctctttggtccaatcacatttctacatggttgtccatgtttcagtcatgcctacccaaagaagtatttataaaaggtccaagagtatggggtcggagggtacagaaagcttccagacagctcagcttccaaacagacttgtggagggtcctagagggtgatgtgtccatggagggcatggaagctctccatcccttcccccataccttccctgtgcatctcttcatctgtatcatttgtcatatcctttataataaactggtaagtat

SEQ ID NO: 423498 - DNA, 1428 bp, Homo sapiens
gcttctcaggctttggaacctgctgtgggagtaaaggctggccttcaaagtttctgttcttaagtctggaggtgattagcattaagccatgggccaagctactaccttcttcctgaccccctgtttttttttttttttggagccattttactgagaagcatgacatctatcaacttcccagatccctgcgagaatggattgaggagtctgagctctggaaatcaaagtggctaagcgagcaccgttattgctgttaagaaaacctgcaatgcgcgagttgaaactttctaagtttggatctgcttttgtctgacctctgcctggatagtaaggcagctgagtgattcacaggcacagaaatgcaccacgttgctattcccagaccctgccacaaaagactgttgaattcccaatgtctccatgctcacttcctgtcctcactgtgactatgaggcactttgaagatttaacacattatagaaacacacagcatcatgtttataataagtctacattctgaatcaaaataatggtttagtcttctcagatgagagggaatatctggggctaaatgagggtaagtcacgtacttttctatgtgcaggcaaaactgattttgttctgagtgagctgcagcctgcagcctcttttcaaagctgactcctagggggtttggccagggctgctttttgcatgaattgttgacattcaaacacctttatctctgatgctgctctacagcttaatgtgatatttctgtccaaactcaacttttgatgagaagaaaagatttttaatccaaaatatgcacacaactccccagccccagggaaaggacttctttgtcttagtgagagcacttctttgagtgctctttgggtggctctgtagctcacttgcagcatgggattgagaaaggaaaagtggagcccagggcaggcagggggttttccagctcctctaaagaggttgcttaccagtgggaccttactgttttgcttggaagtttgagagttaccagttcatcaggatatccacttttttttttttgagatggagtcttgctctgtcacccaggctggagtgcagtggcacaatctcagctcactgcaacctctgcctctggggttcaagtaattctcctgcctcagcctcccctgtagatgggattacaggcatgagccgccaggcctggctaatttttgtaattttagtagatatggggtttcactatgttggccaggctggtctcaaactcctgacctcatgatccacccacctcagcctcccaaagtggtaggattacagacgcgagccatcacaccagctgatatccacttttaaatgccagtgctgtacttggcataaagtagaccatgaataaatgtttgttgaataaatgaatgaatgattaaagcccaaattcca

SEQ ID NO: 423499 - DNA, 1245 bp, Homo sapiens
  misc_feature (1172)..(1172): n is a, c, g, or t
  misc_feature (1182)..(1182): n is a, c, g, or t
  misc_feature (1222)..(1222): n is a, c, g, or t
gcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatcttacacttttagtggaggctnctttaacggnaaaggacccatggcaccatcattcaggaggacttgagganggggggagaggggccttgaggac

SEQ ID NO: 423500 - DNA, 1252 bp, Homo sapiens
gcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgtcctttctgcacctggatatcctcagcattaacaataacaccatcaactcactcattggacttcatgaatgtgtggtggagcctcctgaggatttaactttcaataccatgacttattgatgagacttgtaatcaacaataaaattggaaggcctcctaaccatctgcattagtccattcttgagctactataaagaactacctgagactgggtaatttctaaagaaaagaagtttaattggctcacggttctgagagatagatgtacaggcctctgcttctggggtggcctcaagaaacttacaatcatagtggaagatgaaggggaagcaagcatgtcttacatggcaggagcaggagagagagggtgggggaggtgccacaaacttttaaacaaccagatttcatgagaa

SEQ ID NO: 423501 - DNA, 756 bp, Homo sapiens
ggttcagctttgttcttactttgtttgtgttacactggtatccagtcatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagggcctttgcctcagacatgcatacggcaggagtgtgagatctatggagtgggctcagctcatggagcaaggaggacggcaggggctccaatgatgatgtctgcgtaagaattcccatttaagatctttccaagcacaagagtcatggcccaatggcagagtgtcctatgcccacgaataaatcaaggatgaagaagacatttttggaaccagcatagtttctggtaggatctttgccactactt

SEQ ID NO: 423502 - DNA, 2375 bp, Homo sapiens
gcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaagtgt

SEQ ID NO: 423503 - DNA, 4765 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423504 - DNA, 1182 bp, Homo sapiens
  misc_feature (1182)..(1182): n is a, c, g, or t
gaggaagaggaggataaactgcacgcgatgctctcaatgatctgctcgcggaacctcacagctcccaatccgatgaaagacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagatggcggcagccacggtaccagcaggtgtcggcagaggctggacaggcctcgcacgcggacggcagaggccaacaggggagcggagaggacacaccagccaccacgccacaacggactcgctcacaagcgacacaatcgacaagccacgagcagggcccatcgaacgaaaataccacaacaacaaacgacagcgaacatacacgactacagaacccacacccccaggaccccgcaaaactgcacgaacaatcaccataagacagacaccggtaccgcggaacacggggcaacagacgtgaagaacacggacaagtgctgagacgaaccgagcagcccacaaacaccggacagcgacgacaaaagcaaaacaaccagcgagacgaggactcaccaacacaccaaggaggcgacggcgtgaacacaacgcagccgagcatgggcaagcagaagaccagagagcaagcgaacaaggacgaccgaccgcagacacaacgcaagcagcacgcagcaacaacggatgcaaaaaaaaagaaccaacagtaaacgacgagtcacaaagaacgaccagccgcagacgaacgacaagcgccagacagan

SEQ ID NO: 423505 - DNA, 5014 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtgaggggagcctgttcccatggggctgatgagatggggagctgggccaggggacgccagggaggggaccttggaagcctcagccccttcccagccggaaagaagcatggcagggcagctccaccgtccttaccctgaggcccgtcttgagtctgagactcaggacccaaggtccagtgcaggcccagctcctgaaggggagggcctggtgcacgcttcccccatggtcgtggtgtggtctgagtacaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423506 - DNA, 4848 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctaggtgagcctgagagcacaggcacagtgggtacggggcaggtgctgagggagcatcgtctgggctggctgtctctgtctccacagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423507 - DNA, 4697 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423508 - DNA, 4907 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctaggtgagcctgagagcacaggcacagtgggtacggggcaggtgctgagggagcatcgtctgggctggctgtctctgtctccacagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccggccatccctgagagcctctcagcccttcatcgtcggtcttccggtgtctcccgctgtagaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423509 - DNA, 3652 bp, Homo sapiens
accggcagaattcgtgcgtcctgcatcggcagaattcagtggtgctgcatatgaccctggggaacagactagagtcccccatctgtggaccacagcaatgggaacggggaaatgtgttccccaagcctacggaaacgaagcagtggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423510 - DNA, 3057 bp, Homo sapiens
tattttatctgaaggctgctggggtcccgggtatggagcctgtccaggactctggtgatacactggtggatatggcatattatactggccatacgcataaggattatagcccatgggcatgggcatttggcaatacccaggatatcctggataggtgggatagggtggtccctgcgcctgtggagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423511 - DNA, 2984 bp, Homo sapiens
ccaaaacactaaggccattctcccggtctcatgacttcaggcgtttctagaatgagactgagttcaaactggccattgagcgttcagccccctggctcccctacttcccttcagtagccacaggaagacctggggctgttccttcaagcagggctgaagacgtgtcttcatgtttggccagaggcttgtttctctctgcctggctggctgggtcagaagctggcttggtgccccgtggccacagtgttggaggctgtggtgggagagggggtgtgaagagttttgcattccagctcccttctggcccgaggaggcggtgggctgcgggaaggtgctggagtgcaggtggagccgccctgtgttcaccccccaggtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423512 - DNA, 4706 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtactcggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423513 - DNA, 2477 bp, Homo sapiens
tgctcctgaatcacacttggctccccctgcctggaacgcttttttcctgcacacccctcccccgcgcctcttcattcttaggggcctaccagacctccacttcagccacacctcttcaggaagctttccctcatccccgcaccccgccccacataccaagcgtgacggccttggctctccctaagtcggagtgccttgggggggacccgtgggttgttccccgttgtctccctgtggggggtgcacagtacatgccttagggtcgtggaaaggctgacttctgggcggcaggtggctctggaggacgtcttcccagggatcccgagggagggaagaatggggcacagccacagtgactctccccctgcctttcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423514 - DNA, 4718 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423515 - DNA, 3989 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaagtccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423516 - DNA, 4593 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaacacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423517 - DNA, 4129 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423518 - DNA, 3908 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcacctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423519 - DNA, 3296 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgcgagctggtccagccatccaggctgccctgagcagaggtgtggaggcccccacctctgccccgcacacagctggagggttctcaggaatcctgggggcccttccccaaaggccgggatgtcaagaatctagcagagcagatggaaacagagcagggtagtcagccacctcctagc

SEQ ID NO: 423520 - DNA, 3246 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgagccagacgggacctggagggttgggggtctcgggggccacccgcgttttatgcacagtggtcctgagcaccagcctgacctctgggaactggtggggccctgcgagaaaggcctaaggtgcctgtgtctcattttctccaactggaaatggctaactgtgcctctgctgcctacttctctgggtattgtaggaataaagtgagagagtgcattgtgctcagttttagccaactatagggaaagatggacttactgggatttagggaagccctcctccttgtagaaagacctcaaagctagcaacaggcagcgctgggttctagtcccagatccactactgacaagctgaatgtctctgggcaagcacttcccgtctctgggtctcagtttcccctctccacccatatcctctgactgcagaggcttcctgagatctgtgggcctgagaataggggagcccgtagagcagccccattggtgtcgactggcgagatccttcctccccgcgatgttgcctgtcactgtacagaactgactatggcaggcttgttcggagcacgggagggtagctctttctggcatcactcctgccttttgaacagcaagttctaaactgtgactgcctggcccaaccaacactgataagtttcaattttaaggacgctttattaatttttctttaaaattgcctctttagataatgtgtattcttgttactttactaaatccttaccaacattaacagaaaatgtaagttgaagtaagttaaatataactggctgggtgtgatggctcatgcctgtaattccaacactttgggaggcagaggtgggaggattgcttcagttcaagagtttgagaccagcctgggtaacatggcgaaaccctgtctttacaaaaaatgcaaacctttgccgcatgtgttggggtgcgcctgtagtcccagcttctcgggaggctgaggtggggggaccacctgagccatggaggttgaggctgcagtgagccgtgataccaccactgtactctagcctgggccatagagtgagacaccctgcctcagaaataaataaaaaaaaagaaataga

SEQ ID NO: 423521 - DNA, 118 bp, Homo sapiens
atccctgggcgtgagcggacggtgagtggcggccagaggcagcatcggctcagggctcagcctctctcccttttcccacccacataagatcctggactcagagctgtttgagctgatg

SEQ ID NO: 423522 - DNA, 459 bp, Homo sapiens
aactgtgactgcctggcccaaccaacactgataagtttcaattttaaggacgctttattaatttttctttaaaattgcctctttagataatgtgtattcttgttactttactaaatccttaccaacattaacagaaaatgtaagttgaagtaagttaaatataactggctgggtgtgatggctcatgcctgtaattccaacactttgggaggcagaggtgggaggattgcttcagttcaagagtttgagaccagcctgggtaacatggcgaaaccctgtctttacaaaaaatgcaaacctttgccgcatgtgttggggtgcgcctgtagtcccagcttctcgggaggctgaggtggggggaccacctgagccatggaggttgaggctgcagtgagccgtgataccaccactgtactctagcctgggccatagagtgagacaccctgcctcagaaataaa

SEQ ID NO: 423523 - DNA, 539 bp, Homo sapiens
aaagctttgcctctctccgggcgccatttcctgccccttaaggaaggagagcagaacgagatctcatcccactgtgagctggggcacgggaggacgtggccaccccaaagcaggccttgcctgggcttcagcagtcactacaggccccgccccagcccattctccgtgggatggggctcacccagctgggccacggtgactgtggaggctgcacagtcttgactccccgggtccctcagaactacaaagagctggagctgctgcggcaagtttactacggaggcatagagcacgagatccgcaaggacgtctggccctttctgcttggccactacaagttcggcatgagcaagaaggagatggagcaggtgaggggagcctgttcccatggggctgatgagatggggagctgggccaggggacgccagggaggggaccttggaagcctcagccccttcccagccggaaagaagcatggcagggcagctccaccgtccttaccctgaggcccgtcttgagtctgagactcaggacccaag

SEQ ID NO: 423524 - DNA, 3322 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgcagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaacactggagcctctgggactggac

SEQ ID NO: 423525 - DNA, 2993 bp, Homo sapiens
tgtgcggggctcggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagaggaagctgctggataggatatggggctgaggtcagggacag

SEQ ID NO: 423526 - DNA, 1718 bp, Homo sapiens
tgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatggtaagcatcaccttaagcacatattatgccttgagacactagccaattgtggtacatgaaaataatttataaataaataaatttacctatattaggaagatga

SEQ ID NO: 423527 - DNA, 1053 bp, Homo sapiens
aggttgcagtgagctgagattgtaccactgcactcctccctgggtgacacagtgagactccatctctaaataaatgaataaataaataaatgcagattgtgggcctcccccccagaaactctgattcagaatcagggacgcggtgggatgggaggaatggggcgggacggggtgtggggaggtgggggaggaacgtgtacttcccccagtttcccagggattctgacgccccagataaaacttgagagccacaggtgtaggagatatagaaaaatattgttttttgatttatgtatataatttcaattaatcttcacaagcaaagtgtgtttgcattttatagatcagaaaacaaggctcagaaaagctaactcgctcaaggccacatagatgttaagtggtttcaaacccaggatttttagaagctgctatactgagctgcttcttacagaaaggtggcattggaaattagataagacctgtgtttgcatctgagattgctgagttccacagaatcaacttgctcaagttcccagagccagctagtgacaaagctgtgacaaggcttcacactgagggctgctgggtttcccggttccagctgcctcgttactaacaccaccagtgagagcagtgcaggagatggcagcaggagtgtgcttctggctgggagagttggcaacttctcaaaggaagccaggtgctgacctcagccaggcccccgacttccctgaggccttttccctaagcccaaagtctccaacataggtgtccaacgaaatcccctgaagtgaggaacaaactattaaatattagaacatctcaatgtgtttcatctattctaggtcacactttgttttcacataatcggatatgatatgaagccagccataaagcccaggatgaccaagaatataatttgaaaatgaatttgtttactatccttaatggtaagcatcaccttaagcacatattatgccttgagacactagccaattgtggtacatgaaaataatttataaataaataaatttacctatattaggaagatga

SEQ ID NO: 423528 - DNA, 3638 bp, Homo sapiens
tgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcatcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgccctccctgaggctggcctgccccattccccaagggggctcctctggagtggtggggaggatcaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagaccagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggaaaaaaaagt

SEQ ID NO: 423529 - DNA, 439 bp, Homo sapiens
cgggagcgcttcagcctgctcagtgcccggctggacctcaacgtccggaacctctccatgatcgtggaggagatgaaggcagtggacacacagcatggagaaatccttcgcaatgtcaccatcctacgaggtaagagctgggtccaggtagggctgctacaaagcttccactgaggcttggtgatcttgctggacacagaagtacctggttttaggcaaagtaatagtgggctaacacaatcctatagcaaatgcctacagcagtcggcagctttaagaaatgtccttgcattagccaggcatggtggtgtgtacctatactcctagctgcttgggaagctgaggcagaaggatcacttgagcccaggagttcgaggctacagtgagctatgattgcaccactgcactgcagcctgggagacagagtaagtccttatct

SEQ ID NO: 423530 - DNA, 1114 bp, Homo sapiens
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaaaaaaaaaaaacaaaaaaaaaaaaaaaaaaaaaaaaaacaaaaaagagaagaacaaacaaaaaaaaagaaaaaaagaaagagagaaaacaagaagaaaaaagagaaaaagaaaaaaaaaaaaaaaaaaaagaaaaaaaaaaaaaaaagaaagaaaaaaaaaacaaagaaaaagaaaaaaagaaaaaaaaaaaaaaaagacagggaaaaaaaagcgacaagaaggggaaaaggaagaagagcaaaaaaaaaaaggggggaaaagagagaaaaaaaggaggaagaagaaagaaagggaggagagaaagagaagaaaaagaaagcaagagagagagggaggaagagaagaaaaagagcaggcgcagacaagaaaagaagagaaaaaaagaggaggaagggagaagagagagcgaccaggacggacgaggcgggcgaaggggaggagaggacaaaaaaacagaaacaagacaacaagcaaggaacagaaaaaaagaaaggaaagaaagaaagaaaagagaacagaacaggaaggaaggaacaaaaaaaaaacagaaaagacaagaggaggaaagaagggagcaaaaaaagaagagcaaaagagaaggaaagaagcagaaagaaaggaaaggggacaagaggaacaagagagaaacagaaggaggaagagagagaagaacaggaagaagaaaaagg

SEQ ID NO: 423531 - DNA, 381 bp, Homo sapiens
ggatcatagtccacatagcacagtaactggtatgaaaacactcgatatttgctgaggatggagactgcagccaactcaacaacttctctgtccatctcaccaccaagtctggtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 423532 - DNA, 1533 bp, Homo sapiens
ctgtctaaatctacagtttgaactgcttcttacagtggtgcatctgatttttagtatgtggattctgagagtattaatcaattttttataatgtttggtttccttatgttttctatttcagagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaatgctttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcataaaa

SEQ ID NO: 423533 - DNA, 553 bp, Homo sapiens
ggatcatagtccacatagcacagtaactggtatgaaaacactcgatatttgctgaggatggagactgcagccaactcaacaacttctctgtccatctcaccaccaagtctggtacattatggctttatagtcagtaccatagctgcttcctaaatcttaagcctttaaggaaatgcaaagtagttcctgtccacaagaaatctggtgaccctgtctttctacagtctaagatagagaatccaaaatatagtaactacttttaatgttttcttctgccacacaggtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 423534 - DNA, 309 bp, Homo sapiens
atttacaatttttaattgagggttagggagtcataataccaacaaagatggtaaaaggaatttgaggagaaaacgaaagaacaagggacaaataaaaactgcctgggttattcattattcatactgactccctaataaagtgattttcagtttgaatgtttttgcagacattgcctttcctcccttacagtgcttatttttttaaggtccaggttcacactagaaggccaaaacttccgcaaacatctgatgatgaaaagaaagatttttgagactgcagcctattaataaagttaacataactgagaa

SEQ ID NO: 423535 - DNA, 500 bp, Homo sapiens
ctgtctaaatctacagtttgaactgcttcttacagtggtgcatctgatttttagtatgtggattctgagagtattaatcaattttttataatgtttggtttccttatgttttctatttcagagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaagtaattttctttatatacttttttagtctttaagtagtatccatgtttaaggctacaacctcttaagcagcctctgcagtgtttgtgtaagggcacttgtgaaagaaaatattttccttgatatattaaatagactttcaattctgtggaaatggagaataaaaatccagagtttgtgcctaccaca

SEQ ID NO: 423536 - DNA, 951 bp, Homo sapiens
  misc_feature (453)..(453): n is a, c, g, or t
  misc_feature (463)..(464): n is a, c, g, or t
  misc_feature (485)..(485): n is a, c, g, or t
  misc_feature (492)..(492): n is a, c, g, or t
  misc_feature (499)..(499): n is a, c, g, or t
  misc_feature (509)..(509): n is a, c, g, or t
  misc_feature (527)..(527): n is a, c, g, or t
  misc_feature (544)..(545): n is a, c, g, or t
  misc_feature (549)..(549): n is a, c, g, or t
  misc_feature (553)..(553): n is a, c, g, or t
  misc_feature (568)..(568): n is a, c, g, or t
  misc_feature (578)..(578): n is a, c, g, or t
  misc_feature (605)..(605): n is a, c, g, or t
  misc_feature (619)..(619): n is a, c, g, or t
  misc_feature (623)..(623): n is a, c, g, or t
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaaaaaaaaaaaaaaaactcgagactatctcncggctcatanncccatgagcgtgtaagcaagngtctacntcagagntcccaggccngggtagatcactggcccnaggagcttgtgccccgnnaaanggcngagagaccagcaagnggctcatggntgaggggctggagggcctgtgcctgtnccaccactgtgatncagngaccctgctttttgtggcggctttacccagtttttcgggtgtccacatccgggccagttttcaaggcccctttagtgctaagcccgaggccagataacctgggggggtgtcgtggggcttctgtgttgtggggcccttggaccccaccacttggaagacacggaaggttgcctttacagcgcccctgggccctctgggaactgtgcccttacccgtgttttgccttgtccctggcgccagtggccctctttcgacctgaatcttgcaaggtgcgtgcacttccccggttgtggttccgccgtcggaggggtcgctcccaactggtgtg

SEQ ID NO: 423537 - DNA, 618 bp, Homo sapiens
  misc_feature (427)..(427): n is a, c, g, or t
  misc_feature (429)..(430): n is a, c, g, or t
  misc_feature (444)..(444): n is a, c, g, or t
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaatanannaaaaaaaaaaaaanacttgggcaagcttattgcatgcggccgaatttggggtcattggccaattcgccctaatagggggccgtataaaattaactgggccgggtgtttaaaaaaggggggtgtggaaaaacccgggggtccaccaatttaattgggtggaaaacatccttcttttggggggggagaaa

SEQ ID NO: 423538 - DNA, 1918 bp, Homo sapiens
aggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaatgctttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcataaaa

SEQ ID NO: 423539 - DNA, 351 bp, Homo sapiens
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtaatttatttctatgccagatacatacat

SEQ ID NO: 423540 - DNA, 424 bp, Homo sapiens
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 423541 - DNA, 702 bp, Homo sapiens
aggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagaggtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 423542 - DNA, 626 bp, Homo sapiens
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaaaaaaaaaaaaaaaacttgggggcttctatggggggggggggaaaagggggttttggaattggcgcccttgggcctatagctgttccctggacccagttttttttggtccccagtggggtgagatctgcccgggtccccctaataagggaggcggtataaaattgcggataacgccgggttacccttgcttatatcgtccggg

SEQ ID NO: 423543 - DNA, 396 bp, Homo sapiens
  misc_feature (383)..(384): n is a, c, g, or t
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatcttcagaatccaaatcagggtnncgagctcgaatg

SEQ ID NO: 423544 - DNA, 418 bp, Homo sapiens
  misc_feature (375)..(375): n is a, c, g, or t
  misc_feature (407)..(407): n is a, c, g, or t
gcagtggtatcaacccagagtcgccattatggccggggaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccagggttcacacttaggaaggcccaaaactttaccgccaaacatctaaatnattgaaaaaggaaaggttttttagaggacttncagcctattta

SEQ ID NO: 423545 - DNA, 1427 bp, Homo sapiens
tcagaggcgccccaagagtgaggagaggcaggtggcagaagagccctgctaaggccagggggcctcaggaaaactcccccagcagctcctgggcaccccacggcttacacccgctcctggggcagagggcgatggggttaggggccagccgctgcctgcagggaacccaggccttgcctcccagcgctcttccctggcacgcaccccccatcctgtccccttctggggtccctgccctgaggcctgtcctttcctccccagctctggaaggagtgttgctccctgggcaggtctgaggtgggcttgagggagggtgacacagaggcatgccccacctggcttctggctttctgggcctccgcctctcttcactttgctagaagaagccgtcactgccaggatccgggcattactttgggggtggggaatgttttccatgcaggtggggaactcctgcactttggccagtgtttaatgcccgtggaagcctggcacagagagattcacacccttcacccaccatggtcccggagagcctgatggcaatgcctgacctcaggaacaggagaccaacaaaatacactttcttggcttggtgctgtggctcatgcctgtaatcccaacactttgggagtccaaggtgggtggatcacatgaggtcaggagttggagaccagcctgagcaacgtggtgaaaccccatctctactaaaaatagaaaaattagccagacatggtggtatgcgcctactcaggaggctgaggcaggagaatcgcttgaacttgggaagcagaggttgcagtgagccaagatcacaacactgcactccagcctgggtgacagagcaagaatccatctctaaaataaaaatatactttctcccaaggtccccagcccagagggtgtgagggccttgcagtgggaggtaggtgtcactgcgcatccgtgacagtggggagagtgggatgagggggacccaccagacctctagagcagttttctcccactgtcactttctccctccataatagagggcacaaggggcatcatggggcactgggtgtggctggccagacacctgttcccacctgagtgatgcaggactttcctcaatcacttttgccagctggagacacccagccggcccttgccctgcctcggccctcaacttcagggctggctcaggcccaccgccatttctgtcatggagggcagaggaccacagtgttacagccttctctgtaccacgttcgatgggtcccatgctcttgtactgcatccaagaagaatgaggatatgttgacaatcagatagtgaggaggggctgggcacagtggctcaggcctgggaggctgaggtgggaggatcacttgagttcaaaagtctgagaccagcctggccaactggtgaaaccctgtctctactaa

SEQ ID NO: 423546 - DNA, 1132 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcaga

SEQ ID NO: 423547 - DNA, 2113 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagattggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtcctttt

SEQ ID NO: 423548 - DNA, 319 bp, Homo sapiens
gctcgactgtaagtacacagaggtggtatatttacagctataaaaagatacaataactctaccaattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423549 - DNA, 310 bp, Homo sapiens
gtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccac

SEQ ID NO: 423550 - DNA, 3784 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423551 - DNA, 3860 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtggggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423552 - DNA, 2442 bp, Homo sapiens
ggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423553 - DNA, 2393 bp, Homo sapiens
gttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423554 - DNA, 1974 bp, Homo sapiens
gactctagaggaccccggctatacattatcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423555 - DNA, 1170 bp, Homo sapiens
tcgtgtccgtcctccatcacggtattactcgaacaaaggccatttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423556 - DNA, 2200 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagattggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtccttttactttttatgtttttgagtcctatcagcaatctgaccacatacaaaaagtttacctctttctctatgatttttaggacacttttaaa

SEQ ID NO: 423557 - DNA, 3914 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423558 - DNA, 3868 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaagc

SEQ ID NO: 423559 - DNA, 2378 bp, Homo sapiens
ggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccacgagtgtcagaagactgtgacacagtgcagggcgttgcccagcatgagagccggtattcctggttg

SEQ ID NO: 423560 - DNA, 705 bp, Homo sapiens
gcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttat

SEQ ID NO: 423561 - DNA, 3361 bp, Homo sapiens
aaaccagtaagagaaaatgctaccggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctctttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggtaatcataccttcataatgaagcctccataaaactccagaagaacagattttggagcatttccaggtaactgaacatatggaggtccctagagggtgctgtacctgaagagggtagagggtataggagctccctgtcccttcccacatgccttgctctatccatttcttcatctctatcctttgtactgtcctttataataaaccagtgaacctaagtgtttccctgagttctgtgagctttactagcaaattaaactcaaggaggggtcatgggaaccctgatttataggtttggtcagaagcacaggtaaaaccacctggggtttgaacttggcactggaagtgggcagcagtcttgtgggactgggccctcaatctgtgggatcaaatgccatctctaggggatagcatgggaaactggaggacacctagctggtatctgctgcaaaattgattgcttgcttgatggtggggaaaaaactccacacatttggtcagagaagttttctgtctttattgtggtgtgagagcagaggaaaaaagtttgttttttccgctcagactttgttttaaggaacaggggagagggaagttctgtggtttttgaagttcttagatacgtgtgtgtagctttgtgtggcattatatatagcattatattattttctacccttatctactcatacagaaattgcacagtaaaaacatcaaagtttattcataaaatgtggatctattgcagtcactaaaaatgttgcagaacagattttaatgactgaaagtgttcatgataatatattcaatgaaaatatggttataaagttttatagtcctttttttgtttaatatctatacaaaagctactgaagtgt

SEQ ID NO: 423562 - DNA, 3023 bp, Homo sapiens
aaaccagtaagagaaaatgctaccggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggtaatcataccttcataatgaagcctccataaaactccagaagaacagattttggagcatttccaggtaactgaacatatggaggtccctagagggtgctgtacctgaagagggtagagggtataggagctccctgtcccttcccacatgccttgctctatccatttcttcatctctatcctttgtactgtcctttataataaaccagtgaacctaagtgtttccctgagttctgtgagctttactagcaaattaaactcaaggaggggtcatgggaaccctgatttataggtttggtcagaagcacaggtaaaaccacctggggtttgaacttggcactggaagtgggcagcagtcttgtgggactgggccctcaatctgtgggatcaaatgccatctctaggggatagcatgggaaactggaggacacctagctggtatctgctgcaaaattgattgcttgcttgatggtggggaaaaaactccacacatttggtcagagaagttttctgtctttattgtggtgtgagagcagaggaaaaaagtttgttttttccgctcagactttgttttaaggaacaggggagagggaagttctgtggtttttgaagttcttagatacgtgtgtgtagctttgtgtggcattatatatagcattatattattttctacccttatctactcatacagaaattgcacagtaaaaacatcaaagtttattcataaaatgtggatctattgcagtcactaaaaatgttgcagaacagattttaatgactgaaagtgttcatgataatatattcaatgaaaatatggttataaagttttatagtcctttttttgtttaatatctatacaaaagctactgaagtgt

SEQ ID NO: 423563 - DNA, 832 bp, Homo sapiens
aaaccagtaagagaaaatgctaccggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactgggtaaggcttggagtttcaggtcttccagatgactctctgtctctcccccaatccccaggttgcctggggattacagagaagtactgttctaaaagtacgaatgtcatctagctattaaaagatggagtgtgtgctttctgagccttatttaaaacagaaagctttagcttccattagaatataagctctatgagagcagggcccctgcttgtcttattcgttgttacattctccaatgcttggaactcaataagaattttttaaaggaataaagggtcatctagaattttaaaatgactttaacaaaattgacatgtgttatgaaaatatgtaacattatttaaaaattaaacatggaaaatcccaagtaaaaaaaca

SEQ ID NO: 423564 - DNA, 3334 bp, Homo sapiens
gagcacacccagaagagaaaatgctaccggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctgactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctctttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggtaatcataccttcataatgaagcctccataaaactccagaagaacagattttggagcatttccaggtaactgaacatatggaggtccctagagggtgctgtacctgaagagggtagagggtataggagctccctgtcccttcccacatgccttgctctatccatttcttcatctctatcctttgtactgtcctttataataaaccagtgaacctaagtgtttccctgagttctgtgagctttactagcaaattaaactcaaggaggggtcatgggaaccctgatttataggtttggtcagaagcacaggtaaaaccacctggggtttgaacttggcactggaagtgggcagcagtcttgtgggactgggccctcaatctgtgggatcaaatgccatctctaggggatagcatgggaaactggaggacacctagctggtatctgctgcaaaattgattgcttgcttgatggtggggaaaaaactccacacatttggtcagagaagttttctgtctttattgtggtgtgagagcagaggaaaaaagtttgttttttccgctcagactttgttttaaggaacaggggagagggaagttctgtggtttttgaagttcttagatacgtgtgtgtagctttgtgtggcattatatatagcattatattattttctacccttatctactcatacagaaattgcacagtaaaaacatcaaagtttattcataaaatgtggatctattgcagtcactaaaaatgttgcagaacagattttaatgactgaaagtgttcatgataatatattcaatgaaaatatggttataaagttttatagtcctttttttgtttaatatctatacaaaagctactgaagtgt

SEQ ID NO: 423565 - DNA, 4021 bp, Homo sapiens
gcatctgattcaatctccagtttcctgttcttgctggggctggggtctctcctttaacaaagacacgccgcgcggccgagtccaggggctgcagaggcctggcgcgcgcacgcgcacgcgcacgcccaccgcgcggcttcccgcggtccccggtgctgaggagagagcgatccgagggactgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctaaagcggcttttgagaaggctctggaagtggagcctgacaatccagaatttaacatcggctatgctatcacagtgtatcggctggatgattctgatagagaagggtctgtaaagagcttttctctggggcctttgagaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtatgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggagaaaaaggatttcctcaaattttaaatatgtaacttcagggattcaatccccaaatgtttattaagtagctagaaataattatgtggaaaaaaatgaataatggaaaatagtgagtctcaaattgttctctttttttttttaactaaaacaaatctgcaatgaatctagatgcaattaattttattccttccaactaaaattacaatatttttaggttaaaattattgagatataaagcagccattgggaaattgggagaaatgataaacaaatggaaaaagaagatgtccctaacctacacccatagattaccaaggtttcagtgtactagttttgaatctgttctgaatggagtttttataccctcaatttctggcctttggctattttagcatttcaaagtgacttctatgaagctttttttttaatgtgaaattttcagaatgttgtttttttcatgtagatactccaggaagagttaagcactgctttcagttttaatatccaccttgaggggtcgctgcttgagggctcttatcccaggggactttttaattcggatgttacttaatgtggcttctctaatgtagtttctttgattaccgactacacaattatgtaccatcacagtattagtggaaaagtaccatgtgatttaattctccattcctccaatgtaactcttaaaattattatgtatgtgtgtgtgttttactttttgttttttatcatctttaaaatttctattatggtttgattattataaaaataatgaattctcactgtaaatttcaaaaaaaaaattacaaaagtatgtgaatttaaaaatgagagcagtcccctcaccctaccacagttccacaccctcaaggtaaacttataacttataatttgatatgtaaacttccagatcttttttctatgcgtaatcagacatacatatatactgcagtgtatctcacgtattaatttttaaaaatcttttgttttacttaattctgtttttattattattattattttgtttgatctattaaggaagaacaaggaagggaatgatctttactcaagaatttcagaaagtcagcactgaagtcctgacctatcagtagacacatttgtccctttcagatattttaggatattctagcaaagcaggccatttctcccacctgaaagtacataacttctatcacttgccacataattaaaagaactcacattaagcggttactcagacagttaatcatagaaaagattatttgcttcatcagttcatagaaaagattatttgcttcatcagttaacttgtttttataaatcagggctgtgttcatacacagaaggggcctgagatttctgcactttaaacaagctcctcctaggtgaggatgctgtggctgttctaattacattttgagtagtaaggtctacagcattgttcctcaaacttggctacgtattggaatcacctaaaaagttaaaacaaaacatggatgtctgggtcccgccccatagagaatgacttaattggcatggggtgcagtccaggcatcatgatttttagatttcccagttggaacttgtgcagcaaagtttgggagctactgatggacatgtgaaaagtaagtataaatggaataaaattaattaggctaataggcttaacccaggaaatcctaagttccttgaatatccagtttgcatttggactcctcatcatatacttggtatataatactctaataaaagctgcctgagttgaattgtaaa

SEQ ID NO: 423566 - DNA, 2249 bp, Homo sapiens
gcatctgattcaatctccagtttcctgttcttgctggggctggggtctctcctttaacaaagacacgccgcgcggccgagtccaggggctgcagaggcctggcgcgcgcacgcgcacgcgcacgcccaccgcgcggcttcccgcggtccccggtgctgaggagagagcgatccgagggactgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctaaagcggcttttgagaaggctctggaagtggagcctgacaatccagaatttaacatcggctatgctatcacagtgtatcggctggatgattctgatagagaagggtctgtaaagagcttttctctggggcctttgagaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtatgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggaga

SEQ ID NO: 423567 - DNA, 1080 bp, Homo sapiens
gcatctgattcaatctccagtttcctgttcttgctggggctggggtctctcctttaacaaagacacgccgcgcggccgagtccaggggctgcagaggcctggcgcgcgcacgcgcacgcgcacgcccaccgcgcggcttcccgcggtccccggtgctgaggagagagcgatccgagggactgcgccgcccggacggcctgcagagcgctgccatcatgaggtaagggttttcctttgcctctcctcccaagccctgcgtcggccttggtttcaaaccgggctgcttttattcatttccagcgcagttctgcggccttttcaggggccgagcccctcgcgcccagcaaccgggcatctgcgttggggaccctccccgggcgctctgtcccggcgcgcggcgtctgaagtcgggcctgccggggagggtggccgagtggacgcttctcgggagtccggcccctccccagcgcctaagaaggccggtcagggaggaggaacaggagatgctccccgggagcctgtcccatccctggcgtctgcggtcgggactgtcagggtatgtgccgggcgacgctcccccggaaggcctgtccacccatcgcgacccgacggctcttctcggcagcggcgacggtgaccgtgctgggtccgcggccgccgcctccgggaaactggtcagcgcctgcagagcccccaggcgctgttccgggggcagctgctacgtgccacgggtctccttaggcctgtcgcgtgcctctctttccagctgccattccctcggtgtggcatacgcggtttcgccgcagccctgcaggcgtcacgttcgcctgccactgccagtttgcgtttctgatttctgggtctgagttcttcccttcccaggagctacctctgtaccaagcacagattgttatcgtcccacccaatccgctgttttatgaggatttctttatctgtttcctttactgatttagtatgatggcgtccttttcttgatcattttgtatccccaggggctagcaccccgccctgcacgtggttagtgaaccttccgcatttaatgagttgaggaatgagatg

SEQ ID NO: 423568 - DNA, 660 bp, Homo sapiens
ccacctccagagattgattgggacctaagagactgagtcaggagagggcaagaaagcagctaagtgggaagtttcaggggcactagagcaaatacattgagaaatgggaaatacaaacagcatgcaaaatcacatcctactcctacccaccccactcccaagggaaattgctgggttttggacgaattttcactttgtgtgcaccttttatgtatgtaaaactacaaacatactactttgaaatctgattccgctatttcatgtttgtcttaccatgttattatgtattttcctacatccaaagctacctagtatctcttttgtatgaaggtttcatcatgtatcccccagtgccctttggttgtttttctttgttgtcatttattttggtgggggttggtttgctttttgttgttgtttttccttgtttttataaatgatacagtgacagatgccgttgtggataaatgctgtggcatagtcatcaattccttgatatatattcctagaaagtgcaccaaagggtatgcatggcttagggcttttgatactctccagagttgggataccaagtcacactactcactggagtcaggatgagagttttttgagacaatggtggcaattctgattcaatagattaaaaaatttattactacc

SEQ ID NO: 423569 - DNA, 369 bp, Homo sapiens
ctcgctatggaacctggttttattagtctactctaagtgccctcttaaatgtcaccagagatttgctagttacctcatgaaatggtccttttatttttttcttcatttgacttcacttctcagccatgattttacattgttgaccaccctttctttctttaaattctccacccttcgggaccctttaaattattggcactctttagaatttatttcatttcctaaaatttgctaatattatgtcctcaactgtatttcataaaccttggtaagctcctccagatatatgattgcataatacctcaatgaaaagaagtcccaaatatttatattcttatttgaacccggtgtctggcacttatcaaatac

SEQ ID NO: 423570 - DNA, 732 bp, Homo sapiens
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggtaacgactttagcttcccttccgccccttgcggtgacgtcactggcggaggccggactggggggaggttccctgctcaagctctcttctcttgtctgctgccatgtgagacgtgcctttgaccttctgccatgattgtgaggcctccccagccacgtgaaactggtcgtgaaagacaaagattgaggaggttcaatcacacatcctaaggacaaatcacaagaccaaaggagatgggataacaaaatgcaacatggttgagcaagagctggattttctgaaacaaaacaaaacaaaacaaaacaaaaaacttaattgaaaatacaaggtgggatcctggattggatcctcaaatagaatagtttttctattagtagaaacattagtaaaatttgaatgaggtctgtaatttctttaatagttttgttctggtgttgggtcttgcttttagtcattgtgctatggttaggtaagatgttaacagctgagataactgggtgaagaatattcagaaacttaatttttgtgacttttcctcaagtctaaaataatttcaaaataaatttttta

SEQ ID NO: 423571 - DNA, 1954 bp, Homo sapiens
agcgggggctggttggagagcgcatcccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423572 - DNA, 825 bp, Homo sapiens
ggttcttatgaaatctatacttctttaaaaatggtgattttcgcaattccttgtctttgtttaaatgcataattctctcctctctcgcctcccttctttcagatgttttaggtagaagtagaaagaggaaagtgttagagtttcttccaaagaatatgggaagatgttctgattgcgtcgtttagaacatccagggtctagagttgcagtttttctgggttaaggcactcagaacattttatctatcaaagccacttgggactggtaggtcctgatagcatagatgcaggattccttaatgccctttgcaactccatccctgtaaattcaacgagcctccttctggcttggagatgaaaggaagatgaataagatgattcttactagatctgggatcccaaagctctggctttcggaaaagtgaaatattatttgttccagagggcacataacatgttcctggcacattggagggctattcctcataagctggagctcagcgcttgcccttaaaatgcacttcacccagctcaccgtctcatgtaggccaaagctggaagaaccttagatatcaccacattccagaagcccactgctaaatgttgagtatgtgggcaatcttcttggaagaagagttgaagctgttaccaagtcattggaggtatgcctggccccaagaagggcaaaggatcactgcctagtcccaaggcatcattcagatgtgcatgtgaggagtctctaccaagtgtctctatgttcagtaatacatactcctaccttacccatcactaaggaatttataatctactaaatttgtttttaaaa

SEQ ID NO: 423573 - DNA, 536 bp, Homo sapiens
ttttctctagcttcccttattgtaagaatcagcatgtaatatatgtaacatacaaaatatatgttaatctactgtttatgttattagtaagtcttctggtcaacagtaggctattcgtagttaagttttggggaagtcaaaagttatatgtgaattttcaactgcactggaggttggtgcccctaactctcacattgttcaagggtcaaatgtgtatgtgttatggtttgagtgtgtaccccaaacagcatgtgttggaaacttaatcccaaatgcagcagtgttgggaggtggggcctaatgggaggtatttaggtcacaagggctcaactttcatgaatagataaatgctggttataaaagggcttgaagctctgagctctctgtctctgtttctgtctctctctctgtcctttgatcataggatgacacaacaggaaggctctcacaagatgccaacccctcaatcttggacttctcagcctccagaaacatgagccaataaatttctattcattataaattaaaaagtctca

SEQ ID NO: 423574 - DNA, 376 bp, Homo sapiens
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactgatgacacaacaggaaggctctcacaagatgccaacccctcaatcttggacttctcagcctccagaaacatgagccaataaatttctattcattataaattaaaaagtctca

SEQ ID NO: 423575 - DNA, 1957 bp, Homo sapiens
ctagtataggtacgaggccgggctggtgccagaatcgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423576 - DNA, 2289 bp, Homo sapiens
cgagcccggggatgggactggaggagtttccgtgaccttgcgggctgtttgtgctgagggacagctttatttaaataataatatgcgtgcaggcgccctgcatgattcctggccgcgtgctttctagtaagtgcgcagagacttttcgcaagaattgattcactcttttttccttccctcccgatttttgattggaaacccagacttcctttcacgcctgtcgccaggttaactaggtcactgtttgctctcaggagcaaccctgcctcccgcagttcgcttggtccttgattacaggggaggttccctgctcaagctctcttctcttgtctgctgccatgtgagacgtgcctttgaccttctgccatgattgtgaggcctccccagccacgtgaaactacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423577 - DNA, 1829 bp, Homo sapiens
agcgggggctggttggagagcgcatcccagaccgagaaggtcggaggcagaagccgggaaggagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423578 - DNA, 2029 bp, Homo sapiens
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423579 - DNA, 1122 bp, Homo sapiens
cgagcccggggatgggactggaggagtttccgtgaccttgcgggctgtttgtgctgagggacagctttatttaaataataatatgcgtgcaggcgccctgcatgattcctggccgcgtgctttctagtaagtgcgcagagacttttcgcaagaattgattcactcttttttccttccctcccgatttttgattggaaacccagacttcctttcacgcctgtcgccaggttaactaggtcactgtttgctctcaggagcaaccctgcctcccgcagttcgcttggtccttgattacaggggaggttccctgctcaagctctcttctcttgtctgctgccatgtgagacgtgcctttgaccttctgccatgattgtgaggcctccccagccacgtgaaactatgttttaggtagaagtagaaagaggaaagtgttagagtttcttccaaagaatatgggaagatgttctgattgcgtcgtttagaacatccagggtctagagttgcagtttttctgggttaaggcactcagaacattttatctatcaaagccacttgggactggtaggtcctgatagcatagatgcaggattccttaatgccctttgcaactccatccctgtaaattcaacgagcctccttctggcttggagatgaaaggaagatgaataagatgattcttactagatctgggatcccaaagctctggctttcggaaaagtgaaatattatttgttccagagggcacataacatgttcctggcacattggagggctattcctcataagctggagctcagcgcttgcccttaaaatgcacttcacccagctcaccgtctcatgtaggccaaagctggaagaaccttagatatcaccacattccagaagcccactgctaaatgttgagtatgtgggcaatcttcttggaagaagagttgaagctgttaccaagtcattggaggtatgcctggccccaagaagggcaaaggatcactgcctagtcccaaggcatcattcagatgtgcatgtgaggagtctctaccaagtgtctctatgttcagtaatacatactcctaccttacccatcactaaggaatttataatctactaaatttgtttttaaaa

SEQ ID NO: 423580 - DNA, 1848 bp, Homo sapiens
agcgggggctggttggagagcgcatcccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactga

SEQ ID NO: 423581 - DNA, 2154 bp, Homo sapiens
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423582 - DNA, 1604 bp, Homo sapiens
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactgactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423583 - DNA, 946 bp, Homo sapiens
agcgggggctggttggagagcgcatcccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgta

SEQ ID NO: 423584 - DNA, 827 bp, Homo sapiens
cattccagcttcccgtgcccactgtacatgccccagtgaacaagcgagaggatcttatcgttgctgaggtctgcttgtctcattttatcacaggtcagacagcagttctcgtgcccactgaccggcaccatgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatgtgcctgtgtaattttcttacagtgtggagtttctaaatgtatactgaccatcttttagtgtcttacccacattctggctataggataactctggttttagctttcatctaagaaggagatctggaatttatgtgtaccaggtcagatatgattgatcaatttctggagttgacctagcaaaggtcattttgatccaggtgttccggaataccttttccaatgtgtatacctccacccaaaaaagaaaaaaaaaccaactaaacaactgtttttttgttcaagtcagtcactgtctccttttactgttgattaattggccagtttattttgtcctaagccaaattaagtattttggctccccaattagccaaaccttactgtacaacacacttaattttaaaccttgtgctt

SEQ ID NO: 423585 - DNA, 719 bp, Homo sapiens
  misc_feature (544)..(544): n is a, c, g, or t
ctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtctacataataggttttgcctgttttttcaacattttgaagacattaaaaggccattacatctcagtaatgacagtctgtaaacaaatgcgtttgtaagcttcttcagatagttttgcaatgttttctaaatatcgttgatttaattgtaagcttctttttaatggaattcttggttaaaatgaattgatgattatgaatatccctaggaggagttagcatggagtttgatcattttctttgtactcctttagattttatatttttacacaatcatattttagtatggggtctgtttatgtaactctgacttgctggaaaagttgaaactccaaataatctgaaactagaaaagaaatagcacataattactacccttccccttgggggntctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccg

SEQ ID NO: 423586 - DNA, 2119 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatgtgcctgtgtaattttcttacagtgtggagtttctaaatgtatactgaccatcttttagtgtcttacccacattctggctataggataactctggttttagctttcatctaagaaggagatctggaatttatgtgtaccaggtcagatatgattgatcaatttctggagttgacctagcaaaggtcattttgatccaggtgttccggaataccttttccaatgtgtatacctccacccaaaaaagaaaaaaaaaccaactaaacaactgtttttttgttcaagtcagtcactgtctccttttactgttgattaattggccagtttattttgtcctaagccaaattaagtattttggctccccaattagccaaaccttactgtacaacacacttaattttaaaccttgtgctt

SEQ ID NO: 423587 - DNA, 2065 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgatggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatgtgcctgtgtaattttcttacagtgtggagtttctaaatgtatactgaccatcttttagtgtcttacccacattctggctataggataactctggttttagctttcatctaagaaggagatctggaatttatgtgtaccaggtcagatatgattgatcaatttctggagttgacctagcaaaggtcattttgatccaggtgttccggaataccttttccaatgtgtatacctccacccaaaaaagaaaaaaaaaccaactaaacaactgtttttttgttcaagtcagtcactgtctccttttactgttgattaattggccagtttattttgtcctaagccaaattaagtattttggctccccaattagccaaaccttactgtacaacacacttaattttaaaccttgtgctt

SEQ ID NO: 423588 - DNA, 1418 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgtccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423589 - DNA, 1129 bp, Homo sapiens
ctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtctacataataggttttgcctgttttttcaacattttgaagacattaaaaggccattacatctcagtaatgacagtctgtaaacaaatgcgtttgtaagcttcttcagatagttttgcaatgttttctaaatatcgttgatttaattgtaagcttctttttaatggaattcttggttaaaatgaattgatgattatgaatatccctaggaggagttagcatggagtttgatcattttctttgtactcctttaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423590 - DNA, 716 bp, Homo sapiens
tctagaggatccttacctaaatggctgtaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423591 - DNA, 1536 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctga

SEQ ID NO: 423592 - DNA, 1474 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423593 - DNA, 1373 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423594 - DNA, 1413 bp, Homo sapiens
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgctttaaaattataaaaagcaaagagaagactttgtacacactgtcaccagggttatttgcatccaagggagctggaattgagtacctaaataaacaaaaatgtgcccta

SEQ ID NO: 423595 - DNA, 1043 bp, Homo sapiens
ttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccacgtctgctgtggaaagggctgcgacctggaggctgtgctgttgaacaggcacatcgaggaggtccaacacagcgtcagaactcccacgccctcttctcagctctgccccttggtcagctgtcaggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttgtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtacgtcacgcctgtaatcccagcactttgggaggccaaggtgggcggatcacgaggtcaggagttcgaaaccagcctggccaacatggtgaaaccccatctgtactaaaaatacaaaaattagcc

SEQ ID NO: 423596 - DNA, 442 bp, Homo sapiens
gtcttttgtttttttttttcctttttctggagaacagggtttcaccatgttggtcaggctggtctcgaactcctgacctcaggtgatccgcctgcctcggcctcccaaagtgctgggattacaggcatgaaccgccacgcctggccattcctgtttttcatccttctatccagtggccagcttagagcacatgcctcgccttgtctgtgtctgtaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggca

SEQ ID NO: 423597 - DNA, 235 bp, Homo sapiens
aattgtggactcagcgcaaatatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcc

SEQ ID NO: 423598 - DNA, 4504 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423599 - DNA, 5113 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423600 - DNA, 2562 bp, Homo sapiens
ttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccacgtctgctgtggaaagggctgcgacctggaggctgtgctgttgaacaggcacatcgaggaggtccaacacagcgtcagaactcccacgccctcttctcagctctgccccttggtcagctgtcaggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423601 - DNA, 4511 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcc

SEQ ID NO: 423602 - DNA, 2912 bp, Homo sapiens
  misc_feature (20)..(20): n is a, c, g, or t
  misc_feature (29)..(29): n is a, c, g, or t
  misc_feature (124)..(124): n is a, c, g, or t
  misc_feature (255)..(255): n is a, c, g, or t
gttggaatcaacatatttcncagtgtccncagttaccagcatgcagatagtaaaatataatggtttcctgaagttatctcttaaaaaagattttagtccttcagctattcaaatagatatatancaattgcatatagaacgtagagaaaattttattaaaaaattaaaactatttaaaacctgatatatgaaaataggcaacagtgagaaaaaagcacttttgtgacaaatatttagctggtttgaaagacagancaaggaggaatcatttactcataaagaaggctcaaataagttaaaacatggatgtatttttaaaatgaccactctagtagtgaatttaaaagtcttttaagggttagagtaatctttttcattagtcttggctatttcctctagttctgacaagtacaggcaagaaaatggctactctcaagtaaggattattctgaaacacggtctggatttagaaaataaatgaacattagggaaatttccttaattaagactctccaaaccaggtatggtggctcatgcctgtaatcccagaactttggcaggctgaggcgggcggatcacctgaggtcaggagttcaagaccagcctggccaacatggcgaaaccgcatctctactaaaaatacaaaaataataatacaaaaattagctgggcatggtggcatgagcctgtaattttttttttttttttttttttttttttttttttttggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaactttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423603 - DNA, 1928 bp, Homo sapiens
tggagctcggtacctggtttgcttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423604 - DNA, 3789 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacagaacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctat

SEQ ID NO: 423605 - DNA, 3818 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggtgagcacaccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctg

SEQ ID NO: 423606 - DNA, 2985 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttgtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtacgtcacgcctgtaatcccagcactttgggaggccaaggtgggcggatcacgaggtcaggagttcgaaaccagcctggccaacatggtgaaaccccatctgtactaaaaatacaaaaattagcc

SEQ ID NO: 423607 - DNA, 1781 bp, Homo sapiens
  misc_feature (20)..(20): n is a, c, g, or t
  misc_feature (29)..(29): n is a, c, g, or t
  misc_feature (124)..(124): n is a, c, g, or t
  misc_feature (255)..(255): n is a, c, g, or t
gttggaatcaacatatttcncagtgtccncagttaccagcatgcagatagtaaaatataatggtttcctgaagttatctcttaaaaaagattttagtccttcagctattcaaatagatatatancaattgcatatagaacgtagagaaaattttattaaaaaattaaaactatttaaaacctgatatatgaaaataggcaacagtgagaaaaaagcacttttgtgacaaatatttagctggtttgaaagacagancaaggaggaatcatttactcataaagaaggctcaaataagttaaaacatggatgtatttttaaaatgaccactctagtagtgaatttaaaagtcttttaagggttagagtaatctttttcattagtcttggctatttcctctagttctgacaagtacaggcaagaaaatggctactctcaagtaaggattattctgaaacacggtctggatttagaaaataaatgaacattagggaaatttccttaattaagactctccaaaccaggtatggtggctcatgcctgtaatcccagaactttggcaggctgaggcgggcggatcacctgaggtcaggagttcaagaccagcctggccaacatggcgaaaccgcatctctactaaaaatacaaaaataataatacaaaaattagctgggcatggtggcatgagcctgtaattttttttttttttttttttttttttttttttttttggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaactttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtgagtgccgcctgcacgatccccgctctgtgcccacagcccacagggcctcctgagaagcagccctgggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggagtctg

SEQ ID NO: 423608 - DNA, 805 bp, Homo sapiens
tgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacagaacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctatt

SEQ ID NO: 423609 - DNA, 4552 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423610 - DNA, 4391 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatggctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423611 - DNA, 4572 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcagtggcgtctggcagaaaagctccacgaaaggggcaaagggacagaagagcaggcagtggcagtttccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423612 - DNA, 2238 bp, Homo sapiens
tttgagacagagtctggctcttttgcccaggctggactgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423613 - DNA, 1684 bp, Homo sapiens
tgaggatcccctagctattacagtgtcctcattatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423614 - DNA, 638 bp, Homo sapiens
cagcgctgggcggcgagtcgggtagtatcgactgtgatgacggagacatatgaccggcgtacagcgacgtcgacataacgcaagcaagccgcgcagcccgctacgcattccgtttaccacctccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 423615 - DNA, 3373 bp, Homo sapiens
cgggcctgacggcgggagatcgcgctccggccgggccccgaggcgctgccggggcggcgcggctctgcggggagcagccctcgggcgcgccgagctctcccgccccagcccgcgcggtgaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtcttctccagcgacaagctggctcccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcctgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtgagtgccgcctgcacgatccccgctctgtgcccacagcccacagggcctcctgagaagcagccctgggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggagtctg

SEQ ID NO: 423616 - DNA, 372 bp, Homo sapiens
ttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagc

SEQ ID NO: 423617 - DNA, 1362 bp, Homo sapiens
ccgcgggggcttccaagggacgcggcgaaaccaaaacagtcgccggtggttcacaaaaccacctcagaaaatgcttccaaaggcacgtctggcctccacaaggtgacggcttttcagcctccgactcgaacttgagtcgtccacagcactaggccgccgccagcccgggcgagctgcctagggaccgcggacgccgcagcaagcagctccctgctcccgccacacccgccgagccagccgcgcggaacccactcccccaccgtgggcccgcctcccgccgccagcctgcccacgattggtcgactgggctgcccgtcgcgagagaaggcggtgcctccggcaggccggcgctcccattggccgggatggcggcggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggt

SEQ ID NO: 423618 - DNA, 4278 bp, Homo sapiens
cacgcaacacctacgggtcgaatagagaagaaatgaagcacttcgcaggcatagttggagggagcggagcagggccgacagccagcggaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaaacgaaagagcaacgcagacagagacgagaacaaagagcaggagacaaaaacgtgtgtgggcggcgaacagcggcacccatcgcgagaggcgttgcggagagagcgcacaagggaagggggcagccgcgggaccacaggagaggccacaagaaacacacagatgggaaacaaaaaagaatgaacccaaagagagaacccgggaaacaaaacaaaacggcaaagagaaacaagccaccatataaaaaatacccgctggaggaacaacgagaggagaacggaacacctctcaacaattgaaaagctccccaggagagcacaactacgggggaacattaaagacaaacgaggggaggactacccaaggcgacgcgccgaaggtacaacattaaggcccggaaagcgggggaaccgcgcgacacagcgacgcaacaaggaacagcaagccacaggcaggagcgggacaggaggagaagtgatcaagggagcgaaggaggaggcaaagggacaggggtagggagaagataaacgacacgaccatagccgagacccgcaaggaagggtgagagaggggcgggcggaacgaggagtgaggtattggcggtgtgatgtgtgctagaggagtcgtagtgggagctcggcgctcgggga

SEQ ID NO: 423619 - DNA, 1032 bp, Homo sapiens
ccgcgggggcttccaagggacgcggcgaaaccaaaacagtcgccggtggttcacaaaaccacctcagaaaatgcttccaaaggcacgtctggcctccacaaggtgacggcttttcagcctccgactcgaacttgagtcgtccacagcactaggccgccgccagcccgggcgagctgcctagggaccgcggacgccgcagcaagcagctccctgctcccgccacacccgccgagccagccgcgcggaacccactcccccaccgtgggcccgcctcccgccgccagcctgcccacgattggtcgactgggctgcccgtcgcgagagaaggcggtgcctccggcaggccggcgctcccattggccgggatggcggcggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaattgaatataatagaacagaacagaatagaatagagtagaatagaatagtacagagcagaagagagaat

SEQ ID NO: 423620 - DNA, 4754 bp, Homo sapiens
ccgcgggggcttccaagggacgcggcgaaaccaaaacagtcgccggtggttcacaaaaccacctcagaaaatgcttccaaaggcacgtctggcctccacaaggtgacggcttttcagcctccgactcgaacttgagtcgtccacagcactaggccgccgccagcccgggcgagctgcctagggaccgcggacgccgcagcaagcagctccctgctcccgccacacccgccgagccagccgcgcggaacccactcccccaccgtgggcccgcctcccgccgccagcctgcccacgattggtcgactgggctgcccgtcgcgagagaaggcggtgcctccggcaggccggcgctcccattggccgggatggcggcggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaaacgaaagagcaacgcagacagagacgagaacaaagagcaggagacaaaaacgtgtgtgggcggcgaacagcggcacccatcgcgagaggcgttgcggagagagcgcacaagggaagggggcagccgcgggaccacaggagaggccacaagaaacacacagatgggaaacaaaaaagaatgaacccaaagagagaacccgggaaacaaaacaaaacggcaaagagaaacaagccaccatataaaaaatacccgctggaggaacaacgagaggagaacggaacacctctcaacaattgaaaagctccccaggagagcacaactacgggggaacattaaagacaaacgaggggaggactacccaaggcgacgcgccgaaggtacaacattaaggcccggaaagcgggggaaccgcgcgacacagcgacgcaacaaggaacagcaagccacaggcaggagcgggacaggaggagaagtgatcaagggagcgaaggaggaggcaaagggacaggggtagggagaagataaacgacacgaccatagccgagacccgcaaggaagggtgagagaggggcgggcggaacgaggagtgaggtattggcggtgtgatgtgtgctagaggagtcgtagtgggagctcggcgctcgggga

SEQ ID NO: 423621 - DNA, 331 bp, Homo sapiens
gactgctctgggtacaggggacatagccatggacagaacagacttctccaaaggcccttaaggccagggcactggggctgcttactccatctgcagagtttgtggttagactgaccaggcgctcaggtctggacgggaagccccgcactgcaataaggaactgtggctgctctttcttctcacatccaggtctgggactagcttctcagccccagagacaaaagggtacttcccaaacccaccccactcagtgacactgggccatctctgagaacacagcaagtccctgtggccccagcccactgccatagcgctgtctgccagaatccac

SEQ ID NO: 423622 - DNA, 255 bp, Homo sapiens
aactaagcaaaggcacttcattatatttgtgtttgagattactgttacaaatctaactctaacagtagaaatggttaagtatgccaggaagttcctaaactaatcctaattgggctttcctctgaaaatatttggatagtgttaaaattgtagtcatagtgtatttgcttctctctttttgagaatagcgttttatgagctgatgaaattttttagtgacgttattgggcatgtattaaagatgcatagattata

SEQ ID NO: 423623 - DNA, 509 bp, Homo sapiens
  misc_feature (3)..(3): n is a, c, g, or t
  misc_feature (17)..(17): n is a, c, g, or t
ggntgcatggaatttgnacgagaagtggaagcactgttctatgcatggttcaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagaaatttggagacagacaacttgtcacgcatacagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccacaaaat

SEQ ID NO: 423624 - DNA, 3548 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423625 - DNA, 3267 bp, Homo sapiens
ggccaccggaagcaccgccattggccggtgcgtgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423626 - DNA, 3518 bp, Homo sapiens
tattcgattagggacggcgctttcaggctagatcgctgggaccttgggctgtagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423627 - DNA, 3157 bp, Homo sapiens
cagatccttctggccctgtaccgtctctgctttttgctgggcctcgttcctcggggggcctcctgactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423628 - DNA, 3189 bp, Homo sapiens
tttatttttattagagatgaggttttaccatgttgaccaagctggtctctaactcctgacctcaggtgatccacctgcctcagcctcccaaagttctgggattacaggtgtgagccactgcacctggcccctccctgcttattcttattcttctgccctctatttggggactagtgttacttagtcacttctttattatgtttgcttgtattttgcactttaccactgataccatgtttgctgatccatccctccctttcacagcctgcatacggattacagtttgtagtttggaaacaaaccagagacacttccattaaacagttgtctccttcatctccccctccccctccccctctgatgcttctccagtaacttaggcattttggatttctttcagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423629 - DNA, 965 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccacaaaat

SEQ ID NO: 423630 - DNA, 1162 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgaggtacttcaggtctttcacaagtcacaggtgtagtggctgatgggagcttcaggttcccggtctgggacttcacataacacaggcttgacaccagaaagatgtatccaactatctaatcctagtactttgaccccagaaggcatggccagtactgaaaatggtcccttccactttgattgtaattattgagcaggtgatccctccttctatgttttaacaggtaccttgtctgttggcctgattttgggttggtggttagttcctggtgtggggagcttttgagttccaaactcttgtaaagcctgctgaaataatcccaggttaactaggtattttactaaactggatgtttctggatcagagattagatcattagttaaaaatggccttttgtataacaaaa

SEQ ID NO: 423631 - DNA, 1197 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggtacttcaggtctttcacaagtcacaggtgtagtggctgatgggagcttcaggttcccggtctgggacttcacataacacaggcttgacaccagaaagatgtatccaactatctaatcctagtactttgaccccagaaggcatggccagtactgaaaatggtcccttccactttgattgtaattattgagcaggtgatccctccttctatgttttaacaggtaccttgtctgttggcctgattttgggttggtggttagttcctggtgtggggagcttttgagttccaaactcttgtaaagcctgctgaaataatcccaggttaactaggtattttactaaactggatgtttctggatcagagattagatcattagttaaaaatggccttttgtataacaaaa

SEQ ID NO: 423632 - DNA, 999 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagaaatttggagacagacaacttgtcacgcatacagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccacaaaat

SEQ ID NO: 423633 - DNA, 852 bp, Homo sapiens
cttctgcggcttagtcgacgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggaacgaggcccagcaaaaagcagagacggtacagggccagaaggatctgagagagtgtggccagcttgagcccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaattaaa

SEQ ID NO: 423634 - DNA, 773 bp, Homo sapiens
cttctgcggcttagtcgacgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagaaatttggagacagacaacttgtcacgcatacagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccacaaaat

SEQ ID NO: 423635 - DNA, 713 bp, Homo sapiens
cttctgcggcttagtcgacgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggtaagagcagaccttgtggtgagcagctcaacgtttaacaagcttggacagagagctctccgcagggccccaggggccaaggagggagccttgtttggaggaagcctccttgggtgctctttgcagcagttcacccattcaaaggagttcaccaattcgaagtatgcagttcatggcttc

SEQ ID NO: 423636 - DNA, 716 bp, Homo sapiens
catattatcatatactttaatagcacaacaaaattacaaattaataattgtgggtattttagaatatatatgaaacagctatttggtcaaagaggaaataaaaatactacatctgtttaagtaaaaataagtactctgtatcaaatgatcaacatgaatacaaaataccaaagcttgcctaaagcctaggccgggaacgatggtcctaaacagtttttgtttatgtaggtcctatcaatatttggtgtattaggaattaaaacggaaaaaaattaatatattttattaatataatttttcaaaatctattctatgttaatatataggttgagctgtgtctcttcccaaaattgatatgttgaagttctaacccatagtacctcagaccttatttggagacagtgtctttaaagagctgaaatgaggtcattagagtgagccctggtccattatgactgttgtccttataaaaacagaaatttggagacagacaacttgtcacgcatacagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccacaaaat

SEQ ID NO: 423637 - DNA, 247 bp, Homo sapiens
tggcacgaggcgccattggccggtgcgtgcggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtctctattttcattaaagaagcttaaatattttgtcaagttca

SEQ ID NO: 423638 - DNA, 551 bp, Homo sapiens
ttgtaaggattaaagcagaggggacttccttattatgctgctcaggtagactggaaatctggtttgtttagggatctacctgcttaaagtatcagtctgattatgtggcatttagcctaagtgactctgtcttggtttggtctggtctcatgaggcctagagcaggagctcagtccaaaaccatgtcctctcataattttgtgtaacttgcctaacacctgctccttctcaggaacgaggcccagcaaaaagcagagacggtacagggccagaaggatctgagagagtgtggccagcttgagcccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaattaaa

SEQ ID NO: 423639 - DNA, 3746 bp, Homo sapiens
tggcacgaggcgccattggccggtgcgtgcggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaatccaggagtctgcagtttctaaaatcacacaggtgagtgggcatggtggctcatgcctgtaatcccagcactctggaaggctgaggtgggtggatcacctgaagtcagaagtttgagaccagcctggcaaacatggcaaaactgtctctattaaaaatacaggccaggggctgggcacggtacctcacacctgtaatcccagcacttaggtaggccaaggtgggtggatcacgaggtcaggagattgagaccatcctggctaatatggtgaaaccctgtctctactaaaaatacaaaaaaattagctaggcatggtggcgggctcctgtagtcccagctactcaggaggctagagcaggagaatggcgcgaacatgggaggcgtagcttgcagtgagctgagatcacaccactgcactccagcctgggcaacagagcaagactgtctc

SEQ ID NO: 423640 - DNA, 3295 bp, Homo sapiens
tggcacgaggcgccattggccggtgcgtgcggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423641 - DNA, 3546 bp, Homo sapiens
ccagaaaaaaagatgtgcattggtacggctgggtttaggtcgtattctgtccgcgcgtgtcgtctgagacgctggccttgagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423642 - DNA, 3322 bp, Homo sapiens
cttctgcggcttagtcgacgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423643 - DNA, 3621 bp, Homo sapiens
ggccaccggaagcaccgccattggccggtgcgtgcaggtgagtctggcggcctcaaggttggctcggaggttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaaggatgctgccctgtgcttggtgtcttgatgcatttgtctgtgtgatgtggctcatccatgtcttgcatgatgcttgtggactgtgaacattataagtacactctgcagtgttggcatgccaatgatgccatccctgtgcagcatgctgtgcaccatgtgcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423644 - DNA, 2403 bp, Homo sapiens
  misc_feature (9)..(9): n is a, c, g, or t
ccaacttangtgctaggtacgaggctgggtgtgagctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcgatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcactttgcgaggccgaggcaggtggatcacttgagcccaggagtttgaaaccagcctgggtaacatggcaaaatcctgtctacaaaaaatacaaaaattagcctagcatggtggcgcatacctgtagtcctagctactcaggaggctgaggtgggaggatcacttgagcttgggaggcggttgttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagta

SEQ ID NO: 423645 - DNA, 1249 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctgagcaagctgggaaaaaaaaaaaaaaaaaccggaaaaacaggacggaaggcggggaaacgacagggggcctcacaagtgattggccacaccaaattccaaaaaggagatgaaagagggaaagcaaaagaaagacagagacacacggaacgacagaacgaccgaaagaccgaaagaccgaaagacagaaacacacgaacgacagaacgacagaacgaacgaaacggtggcctcacaatgattggcaaaaacactttacaaaacaggagattttccaaccaccccaacattgtttagtcaacttgattacaaccaattatgattgtcccccagt

SEQ ID NO: 423646 - DNA, 1078 bp, Homo sapiens
  misc_feature (29)..(29): n is a, c, g, or t
gacatcaaaaatggttaggtacgaggctnggttttggagagttcactgttagccgggtgcggctggagcgcaggaccaggccagagccgccccaagtgatctgggcgtgccggagaaacgagcagggcctgcgtggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggacggaacttatagtacctcgcagggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgaggaacgaggcccagcaaaaagcagagacggtacagggccagaaggatctgagagagtgtggccagcttgagcccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaattaaa

SEQ ID NO: 423647 - DNA, 959 bp, Homo sapiens
cttctgcggcttagtcgacgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagagaaggggatgctgcctgggagctttttgggactcccaatagaagacagatttagtctcctggaaggctgcctgatccagttcccacagcagctgccacttgctcaggaacgaggcccagcaaaaagcagagacggtacagggccagaaggatctgagagagtgtggccagcttgagcccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaattaaa

SEQ ID NO: 423648 - DNA, 2430 bp, Homo sapiens
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 423649 - DNA, 1213 bp, Homo sapiens
cgagctgggggcctggcgcagaggggaaaggggggcgccagggtgatggggacccagagcctgctcttgggaacagccagagtaagattggaacccagacttgcagtccagcgctgtttgcattaaaagggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 423650 - DNA, 3051 bp, Homo sapiens
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 423651 - DNA, 3191 bp, Homo sapiens
  misc_feature (2782)..(2782): n is a, c, g, or t
  misc_feature (3105)..(3105): n is a, c, g, or t
  misc_feature (3127)..(3127): n is a, c, g, or t
  misc_feature (3169)..(3169): n is a, c, g, or t
  misc_feature (3172)..(3173): n is a, c, g, or t
  misc_feature (3175)..(3184): n is a, c, g, or t
  misc_feature (3188)..(3188): n is a, c, g, or t
  misc_feature (3191)..(3191): n is a, c, g, or t
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctntagcatgactcgttctaatttttgggtgagctcaggctgtgatgtcagaggtgagctctatctcttattagttgtccagtcttaggcaatttatgaaacctctttgcctcttagcttcctcacttagtaaatggggataatattagtacctacctcactgggctgttgaaagagcttcatgagatgaggcgtgcctggcaatttcatcagtgcaattcagccctcagcagtatatgtttgttgggaggatttcataagatatacataaaatgctgggctcaacgcctgacccacagtcatagttagtgctcataaatgtgaantccctcctgccccattccactntgggtctccctgcacctaaggaatgataatctcaccagcctnggnnannnnnnnnnnctcnttn

SEQ ID NO: 423652 - DNA, 3219 bp, Homo sapiens
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 423653 - DNA, 3123 bp, Homo sapiens
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 423654 - DNA, 96 bp, Homo sapiens
tgcattagaattttggggatggctgtgtagaaagatggttttattagtgaagcatttccaaaacttattatcaggagaacccttaatttctcattt

SEQ ID NO: 423655 - DNA, 442 bp, Homo sapiens
aaaaattgccagtcaagaatatgagacccagcaaagctatccttcagataaataaagtctgtcatagacaagcaaaaactgaagtaatttatcaccactagactggtcttacaagaaataatctagggaatactacatttggaaggaaaaagataataatcactatcattaaaacatataaaagtataaaactcactggcagaacagatacacaaaagagagaaaagaattaaaccttatcagtatagaaaaccattaaatgacaatgataaacaataagagagaaggaaaggatcaatggatgtacaaaacaaccagaaaacaacaaaatataggagtatgtcctcacctattaataaaaaccttaaatgtaagtgaattaaattccccacttaaaagatatagactgaatggattttaaaaaccaactatatgctgccta

SEQ ID NO: 423656 - DNA, 1707 bp, Homo sapiens
  misc_feature (3)..(3): n is a, c, g, or t
  misc_feature (19)..(20): n is a, c, g, or t
  misc_feature (23)..(24): n is a, c, g, or t
  misc_feature (30)..(30): n is a, c, g, or t
atngctaggtaagaggctnngtnntgaatnggccgaggcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423657 - DNA, 2585 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423658 - DNA, 2299 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423659 - DNA, 2615 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatgaaaaaaaaaagtcgacgcggccgcgaattta

SEQ ID NO: 423660 - DNA, 2589 bp, Homo sapiens
  misc_feature (2570)..(2570): n is a, c, g, or t
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaaggatgtcattgaagagtatntcaaatgcaagaaatgaag

SEQ ID NO: 423661 - DNA, 2139 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtactacgctttggcaggtaccgg

SEQ ID NO: 423662 - DNA, 624 bp, Homo sapiens
ccgtacatatcccagcttccttgttcaaggttctgtacttggaatacccttgcgattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423663 - DNA, 481 bp, Homo sapiens
  misc_feature (3)..(3): n is a, c, g, or t
  misc_feature (19)..(20): n is a, c, g, or t
  misc_feature (23)..(24): n is a, c, g, or t
  misc_feature (30)..(30): n is a, c, g, or t
  misc_feature (358)..(358): n is a, c, g, or t
  misc_feature (362)..(362): n is a, c, g, or t
  misc_feature (382)..(383): n is a, c, g, or t
  misc_feature (467)..(467): n is a, c, g, or t
atngctaggtaagaggctnngtnntgaatnggccgaggcgcgtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcacttncttnccctcataatcgctttaaanncaaagccttctctactccaacaatatgtatgttttagtcaaattatcttttctcccgttccccatcacccctcccgtctttcgntagtcttaatatcg

SEQ ID NO: 423664 - DNA, 2064 bp, Homo sapiens
  misc_feature (3)..(3): n is a, c, g, or t
  misc_feature (19)..(20): n is a, c, g, or t
  misc_feature (23)..(24): n is a, c, g, or t
  misc_feature (30)..(30): n is a, c, g, or t
atngctaggtaagaggctnngtnntgaatnggccgaggcgcgtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423665 - DNA, 2230 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423666 - DNA, 2245 bp, Homo sapiens
ccccttctattgtggaagctttgttctttctctctttgcaataaatcctgctgctgctcactctttgggtccacactgcctttatgagccgtaacaggtctgcagtttcactcctgagccggcgagaccacgaacccaccagaaggaaaaaactccgaacacatccgaacatcagaaggaacaaactccagacgcgccactttaagagctgtaacactcaccgcgagggtccgtggcttcattcttgaagtcagtgagaccaagaacccaccaattccggacacattgggaacttagagcagtgcttgggacatggttatcagcgtcagatatttccttaaactagcgtgaagtcgactttaaccttccagcagtgtgagtgagggccctgaccctagaatcaacgcccaaagagctgtggcgctacagcgggcggggacatggggtgcgcatgcgtgcgggggggtacgcgtgcgtgcaagtgcgcgtgcgcgcgcaggaccgctgaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttgggtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 423667 - DNA, 2082 bp, Homo sapiens
aattacggctaggtacgaggctgggtgttggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423668 - DNA, 2425 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagaggtgagtaccccttctgtgtggagaccacggcaccaaggcagcactggacagatgctgccctaaccacagacacacctgcctctggtcccagggctcctgggttgtttcacactgaccccagttggcacctgctccactgtgctttttggaagcagcatcagcctgtctgcctccctaggaacccaggcagctcagctcaccctcttgttccagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423669 - DNA, 2151 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423670 - DNA, 1972 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423671 - DNA, 1930 bp, Homo sapiens
ggcccggggcggggcagcccgggcgaggggcggggcctcagaggaccagtggccgcgctttggtcgcccccgaccctcagccggggtcccccgacgtctgcgctgagggccacactgacccttgagtctcctttcagtaacgatggtgatgatggtttttttagaaagtcttcctgctctgagccagtcaccccagtcttctctcactgggtaatttctgaatggaaacttcccatgactcggaacgcttattggtgaataataaaatgagctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423672 - DNA, 2037 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423673 - DNA, 1308 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423674 - DNA, 2152 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaatgcatcctcccacagagccctggaaggccccagccctgctcccacctggactggctcagtgaggctaattttataattctggctgattttagaactctaagggaataaatttgtgttgttttaa

SEQ ID NO: 423675 - DNA, 823 bp, Homo sapiens
tcaagccacagagtccaggccacctcagagccaggaaatgcatccacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423676 - DNA, 2210 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423677 - DNA, 2156 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagatcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423678 - DNA, 2038 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcacggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423679 - DNA, 2371 bp, Homo sapiens
aattacggctaggtacgaggctgggtgttggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggtatgtggtttcttcccctctctgtcctctttctccccctcacccccagaatgctcacctcagctggtaccttggggcccgtgtagatgccctggaccgagctggtcgcacacccctgcacctggccaagtcaaagctgaatatcctgcaggagggccatgcccagtgcctagaggctgtgcgtctggaggtgaagcagaggtgagtaccccttctgtgtggagaccacggcaccaaggcagcactggacagatgctgccctaaccacagacacacctgcctctggtcccagggctcctgggttgtttcacactgaccccagttggcacctgctccactgtgctttttggaagcagcatcagcctgtctgcctccctaggaacccaggcagctcagctcaccctcttgttccagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423680 - DNA, 2162 bp, Homo sapiens
aattacggctaggtacgaggctgggtgttcggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaa

SEQ ID NO: 423681 - DNA, 695 bp, Homo sapiens
ggcctttctaaggtttatagaatagtaatggcctttactattttataaggtttatagaatagtaatggcctattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttcca

SEQ ID NO: 423682 - DNA, 4443 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgca

SEQ ID NO: 423683 - DNA, 4487 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatcca

SEQ ID NO: 423684 - DNA, 4231 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttcca

SEQ ID NO: 423685 - DNA, 4421 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattgagcattaatgttaacacttttaaattaagtattcacttacgaattttgtcactgtcctatcaacggacataatagaaacatattgcacagaactcacacatga

SEQ ID NO: 423686 - DNA, 4384 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaacaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgca

SEQ ID NO: 423687 - DNA, 3870 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcaacgtgtggtaccgcagctcgcaattcgctaatcactggtcactagcgtgtttccgtgt

SEQ ID NO: 423688 - DNA, 3701 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggcaatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttattggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgagcgggagaaactggctctgagcgggagaaactggctctgagcgggagaaactggctctgagcggg

SEQ ID NO: 423689 - DNA, 907 bp, Homo sapiens
ggcctttctaaggtttatagaatagtaatggcctttactattttataaggtttatagaatagtaatggcctattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgca

SEQ ID NO: 423690 - DNA, 1155 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagcactagtcacttactcctggtctaagggtacatggtattggctgctctacaatcttgaaagaaggtaatttagctcactttcttcccctcaggggaaaaaaaatcaaaatgtgcaagaaaatggacattcttatggatcttgtatgtacatagcaacattgtccactcatattgaatacagtcttcctgaattattccagatttactccatagaatatttcagatagtggaatgtaaaagctaagtattattgacactcactttgaattaagcaacacttttttttaatagaactctatagggttatagaatttataatttttagagttctttggaaaatagttatgtgtgtacagataattcctctaaagaaaaggtgtttttgaaaaa

SEQ ID NO: 423691 - DNA, 1197 bp, Homo sapiens
agcggagtcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaaggtaagtgctgtcagaggataaaaccaaatcacagcattaataacagtgccctaattatgagctgcaataattgctttccagagttagacttcaaatcactgagtagctgacttattaaaagtttttattgttctgaaatgtaaactaatacagtttcttgtagattgctgatgaagtgttaatattgagatgtttaattgggtttcctggcatttttttaatgaaattttttgtggcttaatattaacagaatttctatagtttttaaatagtgacagtccattgggtggtggtggggtggtctgacctaaatcattgataagctgagatgcttttctgtaaagcaataaggaattcagaacttctggtttttattacttgaataaagatctcttataaagaattaaagcagtttggaccaaggagagctga

SEQ ID NO: 423692 - DNA, 339 bp, Homo sapiens
gggggtatacattttatgaaagtatacttggatttcactaatggattgcaatccaagtttgaaaaacattactctaagtcaggagagttgtagataaatatggagcattgtaattgtgtgtgtgtgtatttgtgcatgcacacgcagtatggggggagctgtgagttattttcatacctgaaacactgactacatcctataaaaaattgattgcttaaaaaaaattggcattttcaaaaggtagacttgaggagtgatattgtttgatttttgtttttaagctctctgatccttctgacttaccaaggaatgccttcagaatttttaccattcttgtgg

SEQ ID NO: 423693 - DNA, 3050 bp, Homo sapiens
ggccgaggcggcggcggcggcgagcccgggggcgagggcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccagcgccgggccgccgggcgcgcggtctgggagggcgtgccgccgcggcgccgggccgcgctctgtgaaccggcgaggcgggaaggggccgccgtggtgctcggcacgcccgggcgtgtggcgggcgggcgagagcttgagcgcgatccgggcggccgctgtgcgcaatcagtgcaggctcccgcccgactctgactcggcgcggccgcgacagtgccggccacaccctctgccccgctgccgccggcgccgcttcccaagagctggaggcaggagatgcgcccggggcggccgcgcgtcccagagagccagccccggccgccgtcgcggggaagtgccgcctggtggggtcacggcgcctgaagcccacgtgcgccgccgagcccgaggtggcctcgagcgcggcggctgacagcacagcccgcctgagctgcctcccgcgctcctccccgaggaaaggattttgatttcaaagaaaggaaggaaggaaggacaactcccagcttccccgtcccgccctccccgctccgagggccgcgccaggccatgcccaagaaggcggcggcggcggcgaaccagcagaagggactttcctggcagcccggcgacgaggagcgcggacagtgagtttgctctgccccggttcatggttcctgcaagccctctaggaggccgaaagctgcagcccctccccttgccccgaagagccttccgcgttctctcgccctcgggcccaccccgcgccgcccgggctcccgccgccgcagcccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcaga

SEQ ID NO: 423694 - DNA, 2084 bp, Homo sapiens
ggccgaggcggcggcggcggcgagcccgggggcgaggcgcggacagtgagtttgctctgccccggttcatggttcctgcaagccctctaggaggccgaaagctgcagcccctccccttgccccgaagagccttccgcgttctctcgccctcgggcccaccccgcgccgcccgggctcccgccgccgcagcccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcaga

SEQ ID NO: 423695 - DNA, 2144 bp, Homo sapiens
ggccgaggcggcggcggcggcgagcccgggggcgagggcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagccccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcaga

SEQ ID NO: 423696 - DNA, 2014 bp, Homo sapiens
ggccgaggcggcggcggcggcgagcccgggggcgagggcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccagcgccgggccgccgggcgcgcggtctgggagggcgtgccgccgcggcgccgggccgcgctctgtgaaccggcgaggcgggaaggggccgccgtggtgctcggcacgcccgggcgtgtggcgggcgggcgagagcttgagcgcgatccgggcggccgctgtgcgcaatcagtgcaggctcccgcccgactctgactcggcgcggccgcgacagtgccggccacaccctctgccccgctgccgccggcgccgcttcccaagagctggaggcaggagatgcgcccggggcggccgcgcgtcccagagagccagccccggccgccgtcgcggggaagtgccgcctggtggggtcacggcgcctgaagcccacgtgcgccgccgagcccgaggtggcctcgagcgcggcggctgacagcacagcccgcctgagctgcctcccgcgctcctccccgaggaaaggattttgatttcaaagaaaggaaggaaggaaggacaactcccagcttccccggccccgcctcctctggtgccggcgccgagtccttcgagcagtgccgggacaccatcatcgcgcgcaccaaggggctctccatcctcacccacgacgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcaga

SEQ ID NO: 423697 - DNA, 1477 bp, Homo sapiens
ggccgaggcggcggcggcggcgagcccgggggcgagggcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccagcgccgggccgccgggcgcgcggtctgggagggcgtgccgccgcggcgccgggccgcgctctgtgaaccggcgaggcgggaaggggccgccgtggtgctcggcacgcccgggcgtgtggcgggcgggcgagagcttgagcgcgatccgggcggccgctgtgcgcaatcagtgcaggctcccgcccgactctgactcggcgcggccgcgacagtgccggccacaccctctgccccgctgccgccggcgccgcttcccaagagctggaggcaggagatgcgcccggggccaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcaga

SEQ ID NO: 423698 - DNA, 443 bp, Homo sapiens
ggccgaggcggcggcggcggcgagcccgggggcgagggcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccttcctttcagtttctgcccgctcgctcggaagtgggcggttgacaaaaatggca

SEQ ID NO: 423699 - DNA, 3042 bp, Homo sapiens
tgggagaggacatgatgagtcagtcacgagagcttctgtttgtcacccgcctcttgttgctgaaaagctcttctgtgatgtctgaggataaaaatgcagcaaaaagcaggggatggagtcagtgaccccgtccagcaagccagccctgttcctacacaggcctcatgaatatagtcatcaacctgcctgagtgctttcattgtaaaggtcggtatttaatgtcggttgtacaggaaattgacttagcactttccctgtttttctattgcataattttttttttaacccaaagatattttttttgctgagcctgcccagtattcactgttcacaactttgattactggctacaagaaatattttcttgccttccccaaatcccatactccccagaatctgctggcaaagtgagccctggtacaggatttaattgtgacctcgtcttccctgacctgtgtaagcatctctgtatcctttcggttttaatatctgcactgccaaaagcagtcctcatacttgcaaaaggtctgacaaggttctctccacatacattccagtatgtaaagagaccatgaatatttcagtaagagcaagaacatgactccatcagtgtgaaatttcaaatgtgattataaatatgggagagtcctataggagggtccaccagagataaacttcacggaaaacgttccctaacctcctttaaaagaatagaggatggcagattgttccaaaaggaatggcttgggtttttaactaacaaatgttagcaagcctttcttgaattcactatgtattcaaacttctaatatgctttgtgatttttttctttcatttctttctgtctgaggtaaccaggaattgcgttcaaaatgagctcatttgtgatcaggcttaaaagttgcccaagctgaggtcgtttccccccagtcacaaagcagaatgtttttctcaagacttcataggcacttactggtccgtactatctttggaatataattagaagctttgaatccttgaaaagcaaacctgttctcttcatcaaaaatgctaaccacctgtgcccgtggatcaatatcacctggatgtagtgcttgatatttttcccaactcagaagaaaaccattatggtttagagaggaaatgcagaatggcagaatccaccagagaaattgcacttatcgaaacaggccaaggcctgcatgtgttcggataaatcatttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctaccccactccagaatcaaaagcaatttaattaaagtctcttaagttgtaaagagttttaaatgatccgtgttgaaggcgaatgcctgcaaatgcagtgggtctgacgtcagctgccgggcctgggctgggaggccatttgctattctgtttaaggcaggctggattgtcttattttggaaccagcttggtggggggtttgctttgctactgcttctgagccctgagcttcaaaggctgaaattaatggtgaacaaaattgtgcggctctggccatcccatgcggggcaagcccattgagggttatcattaagtaaagaaataaagagggggaaaaaagcctgcctgttccaaaaacctcatcagataatgacctcagtgattgggttttcattaccaaacagcatccagagattatcaacccatagaagaagggaggggaaaaaaaagaaagaaaggaaaagcaactgtctttctctccctctctttctcctttttttttgcacatcttttctttaaaactgtcagatcatttcagtatttcaaatccgaggaaaacagcctgcctgctgctgtatttgaagttgtaatggtgtcaaaaagtcacgactgactgacagccgtcagtcccagaggggctcattaaatcataaaaacttgacaaggaaataattgcgcattgccagcaacttggcgcctgtttagacgtttttattttctttcattattagtccccaccattacgttcattaacaaattgcattaaacaactgttaagggctaaaaaaaattta

SEQ ID NO: 423700 - DNA, 2256 bp, Homo sapiens
tgggagaggacatgatgagtcagtcacgagagcttctgtttgtcacccgcctcttgttgctgaaaagctcttctgtgatgtctgaggataaaaatgcagcaaaaagcaggggatggagtcagtgaccccgtccagcaagccagccctgttcctacacaggcctcatgaatatagtcatcaacctgcctgagtgctttcattgtaaaggtcggtatttaatgtcggttgtacaggaaattgacttagcactttccctgtttttctattgcataattttttttttaacccaaagatattttttttgctgagcctgcccagtattcactgttcacaactttgattactggctacaagaaatattttcttgccttccccaaatcccatactccccagaatctgctggcaaagtgagccctggtacaggatttaattgtgacctcgtcttccctgacctgtgtaagcatctctgtatcctttcggttttaatatctgcactgccaaaagcagtcctcatacttgcaaaaggtctgacaaggttctctccacatacattccagtatgtaaagagaccatgaatatttcagtaagagcaagaacatgactccatcagtgtgaaatttcaaatgtgattataaatatgggagagtcctataggagggtccaccagagataaacttcacggaaaacgttccctaacctcctttaaaagaatagaggatggcagattgttccaaaaggaatggcttgggtttttaactaacaaatgttagcaagcctttcttgaattcactatgtattcaaacttctaatatgctttgtgatttttttctttcatttctttctgtctgaggtaaccaggaattgcgttcaaaatgagctcatttgtgatcaggcttaaaagttgcccaagctgaggtcgtttccccccagtcacaaagcagaatgtttttctcaagacttcataggcacttactggtccgtactatctttggaatataattagaagctttgaatccttgaaaagcaaacctgttctcttcatcaaaaatgctaaccacctgtgcccgtggatcaatatcacctggatgtagtgcttgatatttttcccaactcagaagaaaaccattatggtttagagaggaaatgcagaatggcagaatccaccagagaaattgcacttatcgaaacaggccaaggcctgcatgtgttcggataaatcatttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctacccca

SEQ ID NO: 423701 - DNA, 5024 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggctt

SEQ ID NO: 423702 - DNA, 5030 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaaggaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctatatcactgcccaacatcagaaaacctgacggctatgattactatgccttttctaaagaggtaaggtattaactaacagtttcccaaggaggtgatatcatttgtgaaaacatgaagataaagtaaaaatgctggctgcaatgatgactgaatgtgagaagttacactacggtacttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttt

SEQ ID NO: 423703 - DNA, 4852 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgatacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaaggaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctatatcactgcccaacatcagaaaacctgacggctatgattactatgccttttctaaagaggtaaggtattaactaacagtttcccaaggaggtgatatcatttgtgaaaacatgaagataaagtaaaaatgctggctgcaatgatgactgaatgtgagaagttacactacggtacttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttt

SEQ ID NO: 423704 - DNA, 1753 bp, Homo sapiens
aaacttttattattgactttactgtcaaaagatatctttaatggctgaaatcaaatattttcagtgaaaaaaatcaatattgagggtagtattcttattgccctcaatttttattttcatttcttcacaggcaagtcacaattcatttgagttttcaggtcactgatagaatgtcatttactttcgcttcacaaatgtgcatgtcatccttgcacaagggccatgctaatctctgtatcattccagttttagtatatgtgctgccaaactgagcacttgtcactttcaattgaaattaaatatataactatgtaatttgctgcatctattcattcaacaagtatttcagtttaataattatttttataatacccttgactaatagccattattaatatcaatatattatatgaaaaatgagaacaaaactgtttcctatacattgtaaaagttgtttgtttcctatacattgtaaaagttgttttccaccttttctgagggtattaaaattaattttcattttccatgtgatattctaatacataacaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaaggaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctatatcactgcccaacatcagaaaacctgacggctatgattactatgccttttctaaagaggtaaggtattaactaacagtttcccaaggaggtgatatcatttgtgaaaacatgaagataaagtaaaaatgctggctgcaatgatgactgaatgtgagaagttacactacggtacttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttt

SEQ ID NO: 423705 - DNA, 4974 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaaggaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctataggtaaggtattaactaacagtttcccaaggaggtgatatcatttgtgaaaacatgaagataaagtaaaaatgctggctgcaatgatgactgaatgtgagaagttacactacggtacttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttt

SEQ ID NO: 423706 - DNA, 1747 bp, Homo sapiens
aaacttttattattgactttactgtcaaaagatatctttaatggctgaaatcaaatattttcagtgaaaaaaatcaatattgagggtagtattcttattgccctcaatttttattttcatttcttcacaggcaagtcacaattcatttgagttttcaggtcactgatagaatgtcatttactttcgcttcacaaatgtgcatgtcatccttgcacaagggccatgctaatctctgtatcattccagttttagtatatgtgctgccaaactgagcacttgtcactttcaattgaaattaaatatataactatgtaatttgctgcatctattcattcaacaagtatttcagtttaataattatttttataatacccttgactaatagccattattaatatcaatatattatatgaaaaatgagaacaaaactgtttcctatacattgtaaaagttgtttgtttcctatacattgtaaaagttgttttccaccttttctgagggtattaaaattaattttcattttccatgtgatattctaatacataacaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggctt

SEQ ID NO: 423707 - DNA, 1502 bp, Homo sapiens
gggactgttgggaaggcatgattagttttgaaatgtgaggacatgagatttgggaggggccaggggcagaatgatatggtttgactgtgtccgcctacccaatctcatcttgaattgtagctcccacaattcccacacatcatgggagggatccagtgggaggtaactgaatcatgggggtgagtgtttcccatgctcttcctatgatagtgaataaatctcacatgatctgatggttttataaaagggagtttccctgcaaaaattatctttttgcctgctgccatgtaagacgtgcctttcgccctccaccaggattgtgaggcttcaccagctatgtggaactgtgagtccattaaacctctttcccctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggctt

SEQ ID NO: 423708 - DNA, 3619 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattattttcgcatgtaaagtacattaagttcgccgtattcagcttgtggacttgtcgcagtttgaggcatactcccatcgtggc

SEQ ID NO: 423709 - DNA, 3441 bp, Homo sapiens
gcggccgcgactattcggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccgctcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgatacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattattttcgcatgtaaagtacattaagttcgccgtattcagcttgtggacttgtcgcagtttgaggcatactcccatcgtggc

SEQ ID NO: 423710 - DNA, 429 bp, Homo sapiens
tagctaggattagaggcctgcgtcactgcgcctgtctaatttttgtgtttttcttttagtagacacaaggtttcaccatgttggccaggccggtctcgaactcctgacctcaagtgatccatccaccatagcctcccaaagtgctgggattataagcgtgagccaccacgctcggcctgtacatgtttttttttaactgtctagatgatgccaatgtgcatccaagatgggatcagtgtctcagatctttgccactctaagcatcagcaggaaattcttagaagtgccaaattgcaggccccaacccagacctattgaatcagaatatggattttaacaatatccctaggcaactcacatacacatcaaagtttgagaagcactgactaggaccaccaagaaacggtctctccatgacatggcatcagt

SEQ ID NO: 423711 - DNA, 2237 bp, Homo sapiens
ttttcccccgctacagttctctatgtattgtgaatattcaatactgtgtaatgtctgcaagtatctttttccaatttgtggtttgtcttgtcattatccttatgttatcttttgataaaaagttacttcacttcagtgaagctgaatatatgaatcctttccttagcctttttatggcctttttaaaaagttctacactgaggccacagagacactctgccatattatattcaaaagacttcttagttttggtttcacatctaggtttttaataaatctggagttgatttgtgtatggaataatggtaatctgggaaatttttttttcccatagggacatccaattgtccaaccacctttactgaaaagtctatcttcatactattgatgtgcaatgcctcttctgtggtatgttaaagtccatatattcttgggtctgtttctcaaattctgtaacactggtctagataactacagcactaagatatagtctcactctttacagtctgatacctggaggggcacatcacccatttttgttgttgttcaagaatatcttgtctcttttttgctctttctgttcctctgtatgtttcagagtcagcttaacaagtactataaaaaatgcttgggattttgactgcaattacattggaactgcggtcgattacctgtttactgtatcctctaatccagtgatagtttatcgctccacttatcagggctactttaatatctctcaaaaaagttttttaaatgtcagagaggtcttgcatagcacttgctagattcttaagtacttaatgttttttcatgctatggcatctttttctaaattttactgtttatatatatataaatacaattgatttttatactgactttctatccaacaaccttgcctaccttttattaattctaaacatttatttctagattcttgtggattttatatttgtataatcatatctgtgcaaaataagtaagttttgtttcctctcatatgtaaatacaattgatttttatactgactttatatccaacaactttgccttttattaattctaaatatttatattcttatggattttatatttatataatcatatctgtggcaaaataagttttgtttcctctcaatcctcctatcgtttattttttcctgctttcctgtgctataatttctagtaaattactgaagcgggactaacttgtccctaatttcaaaaggaaagcattcagtgtatcactactaaatatatttactacaaatttcttgtagatatttttcaggttaaggaagttccccctttctatttcccagtttgctaacagtttttatcaggaaggaatattggattttatcaagtttgctgcactttctaaaataaccagtgttctcctttagtgtaaagttgaaaccaccttgttcctgatgtgtcatcctatttatgtagtgccaaatccactttgctaattatttttccgagattttgcatctgagtgagatgttcctcgaattttcctttcccatattttgccaagtattgttatcaaggttatcctggccttaaaaaataagttgaggaatgttcccttttttggcttgtgcaaaatagtttgtgtaaaagtgacctttcagtcattatttcttaaatgtttagtaaaattggccagagaagccacagctttcttcgtgaaaagattttgggctactgattgaaattctttagggcaggggttggcttataacctattttgctactgccttcaagctaagaatggtttttgcaatggttgttaaaaacaaaacaaaacaaaacaaaacaaaaaactatgtaaccaagactttaggtggcctgtaatgcctgaatatttactatctgacccagaagaaaattgctgattcttgttctataggcttgacaaatttctatctcattgttctatcaattagaaaaaagcatgtctaaatctcccattataataataatttgtctatttctccttgtagttttgtcaatttgtgcatttttactttgaaatgatgtcacttggtatataccattttaaatcgctattttttttttttttttttgagatggagtctatggatcatgtgcaatcatggacttcattggtgaagcattggcttagttttgacatttgctactactctgaagaactaaaactgcctcagtctcctaactacgttggattaaagggcctggttaaca

SEQ ID NO: 423712 - DNA, 401 bp, Homo sapiens
aaaaactatgtaaccaagactttaggtggcctgtaatgcctgaatatttactatctgacccagaagaaaattgctgattcttgttctataggcttgacaaatttctatctcattgttctatcaattagaaaaaagcatgtctaaatctcccattataataataatttgtctatttctccttgtagttttgtcaatttgtgcatttttactttgaaatgatgtcacttggtatataccattttaaatcgctattttttttttttttttttgagatggagtctcgctctgttgcacaggctggagtgcaatggcgtgatcttggctcactgtaatcttcgcctcccaggttcaagcaattctcctgcctcagcctcccgagtagctgggattacagtcacgtg

SEQ ID NO: 423713 - DNA, 1043 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423714 - DNA, 1155 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgccttatgtatacatatacacgtcatatctgactatggacgaacggtttattctgtgacagtcatacatctctgcagtcaaagaaaccgaggctcaaagaaattaggaaacagctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423715 - DNA, 901 bp, Homo sapiens
  misc_feature (782)..(782): n is a, c, g, or t
  misc_feature (820)..(820): n is a, c, g, or t
  misc_feature (830)..(830): n is a, c, g, or t
  misc_feature (851)..(851): n is a, c, g, or t
  misc_feature (853)..(854): n is a, c, g, or t
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcccttggtgtggagtcaaagtcccttgtgggtcaaattttagaatggttctnccaagaaggggaggggggttaaagaagaagaccggctnttaattgggnagggggggaaagaggccgggngnnacaataaaaaaattgggagggggtggcccggtttaaaggtgattaaa

SEQ ID NO: 423716 - DNA, 905 bp, Homo sapiens
  misc_feature (742)..(742): n is a, c, g, or t
  misc_feature (779)..(779): n is a, c, g, or t
  misc_feature (784)..(784): n is a, c, g, or t
  misc_feature (789)..(789): n is a, c, g, or t
  misc_feature (791)..(791): n is a, c, g, or t
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgccactgaaantggaagtaattggaagttgaagcccatcctaggaaantatgntgggnanatgcctcttggtgggggccaagtccattttggtcgaatattaacggtgtttttcccacagaggagggggcgtgtaaagaagagccgcataattggagaggagagagcgggagca

SEQ ID NO: 423717 - DNA, 414 bp, Homo sapiens
  misc_feature (1)..(1): n is a, c, g, or t
nacgcacgtcgtctatagtgagtcgtactcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423718 - DNA, 897 bp, Homo sapiens
  misc_feature (580)..(580): n is a, c, g, or t
  misc_feature (584)..(584): n is a, c, g, or t
  misc_feature (595)..(595): n is a, c, g, or t
  misc_feature (598)..(598): n is a, c, g, or t
  misc_feature (600)..(600): n is a, c, g, or t
  misc_feature (602)..(602): n is a, c, g, or t
  misc_feature (607)..(607): n is a, c, g, or t
  misc_feature (609)..(609): n is a, c, g, or t
  misc_feature (611)..(611): n is a, c, g, or t
  misc_feature (618)..(618): n is a, c, g, or t
  misc_feature (622)..(622): n is a, c, g, or t
  misc_feature (625)..(625): n is a, c, g, or t
  misc_feature (630)..(630): n is a, c, g, or t
  misc_feature (632)..(632): n is a, c, g, or t
  misc_feature (639)..(639): n is a, c, g, or t
  misc_feature (644)..(644): n is a, c, g, or t
  misc_feature (646)..(646): n is a, c, g, or t
  misc_feature (648)..(648): n is a, c, g, or t
  misc_feature (650)..(650): n is a, c, g, or t
  misc_feature (778)..(778): n is a, c, g, or t
  misc_feature (816)..(816): n is a, c, g, or t
  misc_feature (826)..(826): n is a, c, g, or t
  misc_feature (847)..(847): n is a, c, g, or t
  misc_feature (849)..(850): n is a, c, g, or t
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtgnggtncatcatttganggncncnaggangnancagctgntttnatngactngnatcttanatagnantnantggttgctcactgaaactgaagctattggagtttgagtcattcctagtgaaaattatgttggacgatgccttgatgcccttggtgtggagtcaaagtcccttgtgggtcaaattttagaatggttctnccaagaaggggaggggggttaaagaagaagaccggctnttaattgggnagggggggaaagaggccgggngnnacaataaaaaaattgggagggggtggcccggtttaaaggtgattaaa

SEQ ID NO: 423719 - DNA, 874 bp, Homo sapiens
  misc_feature (778)..(778): n is a, c, g, or t
  misc_feature (780)..(780): n is a, c, g, or t
  misc_feature (809)..(809): n is a, c, g, or t
  misc_feature (843)..(843): n is a, c, g, or t
cggacgcgtgggtcgccacgcgtcggacccacgcgtcggccacgcgtcgcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcccttggtgtggggtccaaagtacactgctggtccaatttttagaactgctttcctaccaaagagatgggatgggctgttaaagaagaaatgactcncntattaatttgggaaggcggggggagaggnccggattgcaacaattaaaaaaagattcggaaangatgtgccagtttaagtgaaatcgggttaaa

SEQ ID NO: 423720 - DNA, 955 bp, Homo sapiens
cggaagggcggagttgccggcggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgggttgctcactgaaactgaagctattggagtttgagtcattcctagtgaaaattatgttggacgatgccttggggggcagttcattggggtaaatttgacggtctcaaaagggggggggtaaaaaagacgtaaaaggagaagggaggggggggccaaaaaatgggggtgtcgtaagataaaagcgcggcgtgatgggagtga

SEQ ID NO: 423721 - DNA, 816 bp, Homo sapiens
cggaagggcggagttgccggcggccacttccgcttccgctggggaggtcctccatgcgcagtcatgagtcgcttcaagtttatcgatgacttacaggatgtaatagggagagctgtcgagattggtgttaaaaagtttatgattacaggtggaaatctacaagacagtaaagatgcactgcatttggcacaaacaaatgatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaagttgtctaaagaaatactatatatcg

SEQ ID NO: 423722 - DNA, 480 bp, Homo sapiens
catttccactcagttaatgctataattggtgaacataatacagatggctgctttaataatttacttgaacctggttcttagctctagttatatgcaagacagtccataaatctgtttccagttactggcagtaagtttttctattgatattgctgaaaaacttaataactgttaagctttattatattaaaggtgtgccaatattttcctttgtgtggaaaaatattatatagctttagaactaaatgtatacttggagatttaaccatttttgtttttgttttgttttagtcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423723 - DNA, 1068 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaaaaaaaaaaatggtgtaagaagtcgg

SEQ ID NO: 423724 - DNA, 1113 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaaaaaaaaaatcaaattcaaacattcaattcctcttttgatgcatcctctctcaaatcttttaacaaaataa

SEQ ID NO: 423725 - DNA, 1316 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaaaaaaaaaaaaaaaaaaaaaaaaaaaaaaaaaaaaaaaaaaaaaaaaaaaaaaaaaaaaaaaaaaaaaaaaaaaaaaataataaaaaaactaaaaataaccaataaaattactaataccaataaccttaaccaaaaccacctcatataaaaaccttacacaaacctaactactccttctttttcaaattattccacctctccacactcccaatcctcatcttaacccttctttactttcttaactatttaatcttttatataactctcttttcc

SEQ ID NO: 423726 - DNA, 858 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgggttgctcactgaaactgaagctattggagtttgagtcattcctagtgaaaattatgttggacgatgccttggggggcagttcattggggtaaatttgacggtctcaaaagggggggggtaaaaaagacgtaaaaggagaagggaggggggggccaaaaaatgggggtgtcgtaagataaaagcgcggcgtgatgggagtga

SEQ ID NO: 423727 - DNA, 1119 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423728 - DNA, 1069 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423729 - DNA, 966 bp, Homo sapiens
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423730 - DNA, 1140 bp, Homo sapiens
cggaagggcggagttgccggcggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423731 - DNA, 1216 bp, Homo sapiens
cggaagggcggagttgccggcggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423732 - DNA, 994 bp, Homo sapiens
cggacgcgtgggtcgccacgcgtcggacccacgcgtcggccacgcgtcgcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423733 - DNA, 977 bp, Homo sapiens
cggaagggcggagttgccggcggccacttccgcttccgctggggaggtcctccatgcgcagtcatgagtcgcttcaagtttatcgatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423734 - DNA, 1153 bp, Homo sapiens
cggaagggcggagttgccggcggccacttccgcttccgctggggaggtcctccatgcgcagtcatgagtcgcttcaagtttatcgatcataggtgacagtgatgtgacacgattcagtgagcccaataactgaggcttcaacttaagagttgtggttttctcctggttacaaacagtgccgttttctactcttactttgttttgaaaacgaaaagtcaatatttgaagaactcttaaataataaaatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423735 - DNA, 1053 bp, Homo sapiens
cggaagggcggagttgccggcggccacttccgcttccgctggggaggtcctccatgcgcagtcatgagtcgcttcaagtttatcgatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423736 - DNA, 1166 bp, Homo sapiens
cggaagggcggagttgccggcggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423737 - DNA, 1026 bp, Homo sapiens
cggaagggcggagttgccggcggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423738 - DNA, 943 bp, Homo sapiens
ttgctaattgacttcccttgattctcctgggtccgtctgtgtcgaaacctagtggctccagaaggtaatagtgcaaaagctcgcgtgtgacctctagcccaacagacagagcatggcacatgacaatctcgcgtactaaactcacatgagatatgaaaaaacagcgtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423739 - DNA, 436 bp, Homo sapiens
tcgaaagacatatgtatgattgatgtaggtaaagaaagaaacaaatctgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423740 - DNA, 510 bp, Homo sapiens
gtggaggttgcagtgagccaagatcgcgccattgcaccccagcctgggcaacaagagcaaaactccatctcaaaaaaaaaaaaaaaagtatcctctaacagaaaattcatcagtattttaaaaattcttttaaatagtgccataaaattactaagctttcctcatgtttttgcctaagaatatatctattcctaaaccccttcctggagcttctgcactaatgctagtgcagagacagcaacactgccactctaaagagagaaattctcggcagctaacgttttgcatcatgtcactggagatgatgacaggttgtaattgtgaaaaataatatgaaaataaaaattatagcgactaccacctttgaaaccctgaggtccaaaaacttacagggatctatatttttgcctacaaagtcttattaatgtcacttagaattttaaagagtaattattataataataaacttatacctgtatgtccccaggtgcattcatttgatggtaccaa

SEQ ID NO: 423741 - DNA, 528 bp, Homo sapiens
tacgatgtttgcaaaatgtgtaattctttattaaaaaatattcaaaaccagtttcacattcagtagagatagaaatttgtttaacttatgcaaacctcactacatgcatagcgaaaaagattttgaaaactgaaaaaaaaactgtttaacttaaatgttttcatgttgttatacaattgtatttaaggtttaggtcttttttttaaagcatgctgcacaccaacaatgttagcagaaaaaaggaatagaagtgagtcttagaaggtatttaagatgcaattcaagattttatcttgtgcttttcttagaactgttttctgttgaaataactgtgccattttggaagctgaatcacggtttatcatttagaggttatatattagataatggtcataaaaaatttttaaaaatgtaaaccccttacgagacactttctttgcttaactagatgcaccttggtgtggagtcaaaagtacacatgctggatcaaaatatataagaactgcatttcctaccaaaaagaagtgg

SEQ ID NO: 423742 - DNA, 497 bp, Homo sapiens
  misc_feature (1)..(1): n is a, c, g, or t
nccccactactccacggttggctccacaccaaggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 423743 - DNA, 2637 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423744 - DNA, 2557 bp, Homo sapiens
aagctttggtacttaacgtgtaaacggcgcgtcatccctgcggcccacagcccgtccttggtgctgtcgtgtgcagcgtgggagggggcttgggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423745 - DNA, 2820 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423746 - DNA, 2303 bp, Homo sapiens
ccggtgtttatcgatgccacgtctgatctgaggtcgcgggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423747 - DNA, 3065 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggtaagttactgggagtttgcaagacggtgagtggaaaagggctttcttactggaaagctgccttcccctgccccctgccccagtgaaagtttgttagaattgactctggacaaacatcccgtcccatcctcctttggatcctcagggtcgggaaggggtatcaggtctggggacctccatggagagacctcaagtagcctctcctagtgctctgagctgaccacactcccccattctggcctcaggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423748 - DNA, 2694 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcaggggaaactgacgcagggagccatgagccctcgaggccacactttagggggcagaggcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423749 - DNA, 1471 bp, Homo sapiens
gagaagggaaccccacgtctgcacagctgggcccctgcactctgctgcgtggcccaagtcaccagtgggagtaactccggaactgagggcttgttctgggcccacctcagagggagaggggtgtgcgctggcaggggacagggtggctgctgacctgggcatctgctctcccccaggcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423750 - DNA, 1295 bp, Homo sapiens
ggactagaagtacaaagaaagagaaagtttggggagatggataacaagctcagctgtgtcagtgatgtggaggggaggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423751 - DNA, 2531 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423752 - DNA, 2861 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaaaaaccagaaaccagggaacgaaaagaaaaactgtggtgggcgaggcaggccctggaaaggctttcaaacccatccggtgggcgcccggcccagtggggttacgggaccggtgcccaagggtgcccagagaaccgcgcaggcagggtgggtctcccaataaaagccggggaccgcggcggaaaaccaggctcgaggcaacgcctcacaggcaggcgatagccgcg

SEQ ID NO: 423753 - DNA, 2393 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctattgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423754 - DNA, 1981 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423755 - DNA, 1903 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 423756 - DNA, 1831 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggtaagttactgggagtttgcaagacggtgagtggaaaagggctttcttactggaaagctgccttcccctgccccctgccccagtgaaagtttgttagaattgactctggacaaacatcccgtcccatcctcctttggatcctcagggtcgggaaggggtatcaggtctggggacctccatggagagacctcaagtagcctctcctagtgctctgagctgaccacactcccccattctggcctcaggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgtgggtccgggggggggccgggactgggcaggtgggtgggcacaggcatggggagtcctcc

SEQ ID NO: 423757 - DNA, 384 bp, Homo sapiens
tccctgctttttcctgggcacacatgcaggctgttccctacctgagaccagtcacagactatccccatgccacgcctccaccccagcccccaccaggaccccagcaccagtgcctttcccagcccttcctgagttacagggtgcgggggagcctgggaaaaaagaagaaaaagaaagcactcactggcctccacccggggcccctgcccctcccaaggccatgaccctcactgcccgctcccccggctctcccctgccccagttctccaccttcatcaaggctcaagtgagtgagggcaaaggacgcctcatgcctgggcaggaccctgagaaaaccataggagacatgttccagaaccaggaccgcaaccaggacggcaagat

SEQ ID NO: 423758 - DNA, 1250 bp, Homo sapiens
gagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatggtgagggtgggcaaggacacaaggggaaattccgcagaagagggaaaaaccaggcctccacatacagttgctcaggttgtatactgcacgagggcatccaaccaaggactcaaggtgggatgaaatctacccttggtgctactaagaaggggtgctttggccgggcgtggtggctcacgcttgtaatcccagcactttgggaagccaaggcgggaggatcacgaggtcaggagatcgagaccacggtgaaaccccgtctctactaaaaatacaaaaaaattagccgggcgtggtgggggcgcctgtagtcccagctactcggagaggctgaggcaggaaaatgacgtgaacccgggaggcggagcttgcagtgagccgagatcgtgccactgcactccagcctgggtgacagagcgagactctgtctcaaaaaaaaa

SEQ ID NO: 423759 - DNA, 3610 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423760 - DNA, 3717 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaaagtttctagaattttatatcattggatgatatgttgatcagccttatgtggaagaactgtgataaaaagaggagctttttagtttttcaaaaaaaa

SEQ ID NO: 423761 - DNA, 1429 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggtaggacgcatcctagggcaaagcctctcccctctccccgtgctgttctctttcccgtactaaataaacttccgcctcagaggggctgtcgcagctgcgggtcgggagaggccgggcatcgaactcaggccctcgtggggggggtctttctcttcgagtgaatgtggaaacagctcttacaagataaagtagggcttcgctgagtctcctgggggagcgatgccattgtaggatcgcgctggaagcagcagtcaagcggccaaatgcgggctgcaggggctgagcagcagcagcgcgcacccctaaaagtagcaaggagccagcttcaaaacctctagtgcgggtgccccctagggccgccgactgagctggcacgggccggtccattcccggcgctgtagggagcacagcattctctggaggcgagtctcctcccgggatccaggatccgctcgcgccccgctcagcctccggccttcaggcggtagagggcggcctacgcctgtgtgcgagccggagccggcgtgcgcagccgctgccctgctggaactgtgccgtcccgctgtggcccgcggctctgctaggcggtggatgctgctgct

SEQ ID NO: 423762 - DNA, 1002 bp, Homo sapiens
  misc_feature (4)..(4): n is a, c, g, or t
  misc_feature (958)..(958): n is a, c, g, or t
  misc_feature (1002)..(1002): n is a, c, g, or t
ggcncgacccgagcagccggttccctcctctccaggccccctcctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaaaccaaacagaaattgaaagaactttgaaaggcgaaatgggcccgaaattcctcctccccggggattaccccaanaaaaagggccccttaattttggaattcaaagggggggcccaaan

SEQ ID NO: 423763 - DNA, 2852 bp, Homo sapiens
  misc_feature (4)..(4): n is a, c, g, or t
ggcncgacccgagcagccggttccctcctctccaggccccctcctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcaggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggattctgatggcaattactgtctcattagtgaacaataaaagaaaaattgttgtattagcacaacctactactgtgaagaggaaaagaattaccccatacaagtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423764 - DNA, 3556 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423765 - DNA, 3186 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423766 - DNA, 1455 bp, Homo sapiens
atcctaatcctaaacttcaaattctttaagggcacaaactatgtcttactcattttggtatcatgagtgcctagcttggaccactgtgtatgtagctcttaataaatgtttgttaaaattaactaattcatattcttaaattcttttgtactatatagagatagagagattttaattgtaataatctttcgtgagtttttcttctttatttgaaaaaggatccagacacagagatgaagaatgacttgtaccatcttctgagaacaaatggactgaaagcttgtgactagaatccactacttttcaacctcttactcctagagcccatccttttggccaagggcttttagattgctgtgaaggagagtgtttatatactaacaatttcttttaaattctttcccaaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423767 - DNA, 2492 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaatcatgaagcagtagaccacatgatggagctgacagccatagccacagcctgtgttgatagtgacataccagcttgtgggctgtgcgtgcagtccttgggattctgaagatatgttattctccgctgaaccagttctgtcagatctttggcctctttttcccgccaatcagcctgcgtccatctgtctgactgaggtagtatagatccgtcattatagacctttcatgatgtcctcactcctaaagaaattcatctgcatgtctttggagttcatttccttctaagttccttctaatttcttccattcactctgtaggacacacccccgctctttagctccca

SEQ ID NO: 423768 - DNA, 1223 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcaggtactgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttaggaggctgaggcaggagaatggcgtgaacccaggaggcagagcttgcagtgagccgagatcctgccactgcactccagcctgggcgacagagcgagactccgtctcaaaaaaaaaa

SEQ ID NO: 423769 - DNA, 302 bp, Homo sapiens
tggttcagcggagaataacatatcttcaggtaagaaggttgggttaagaataaatttgagtgaaaaaaagaaggatcataatataactaagagtaataatttcagttgtttttagtcttcctggcccttgaaaatcagtactcacacattttacatatttattcagaaagacactgtgttatgccttgagtggaatacaaagatggctaaaacaaagaccctgtcctaaagggagctacttcttacacacgtacacacacacacacacacacacacacacaatacaatacaaatataacatc

SEQ ID NO: 423770 - DNA, 237 bp, Homo sapiens
gattctgatggcaattactgtctcattagtgaacaataaaagaaaaattgttgtattagcacaacctactactgtgaagaggaaaagaattaccccatacaagtaagagatttcatatttattaacatcagcagcaatattataatgattttgaaaaattgcttggttgttttaggtgaaattataaataaaaatctgtctattggaatcattttagcattaatgaatctacagaaa

SEQ ID NO: 423771 - DNA, 3287 bp, Homo sapiens
  misc_feature (4)..(4): n is a, c, g, or t
ggcncgacccgagcagccggttccctcctctccaggccccctcctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaaagtttctagaattttatatcattggatgatatgttgatcagccttatgtggaagaactgtgataaaaagaggagctttttagtttttcaaaaaaaa

SEQ ID NO: 423772 - DNA, 3180 bp, Homo sapiens
  misc_feature (4)..(4): n is a, c, g, or t
ggcncgacccgagcagccggttccctcctctccaggccccctcctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423773 - DNA, 3258 bp, Homo sapiens
  misc_feature (4)..(4): n is a, c, g, or t
ggcncgacccgagcagccggttccctcctctccaggccccctcctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagattctattttgaccagcaataagttgaattatggggctagaagataaggactaaaaacaagaattggtgtccagaaagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423774 - DNA, 3586 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtacctgcccgggcggccgctcgaaagggcg

SEQ ID NO: 423775 - DNA, 3557 bp, Homo sapiens
tacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagagtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcaccggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaagg

SEQ ID NO: 423776 - DNA, 658 bp, Homo sapiens
cctcattccacccccgccgcctggcccagcgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggtgaggggcgcccgcctctccagccgggacgcggagctgcgccgctgctgccctcggcgtcgcgcatccttgcctagggcaggg

SEQ ID NO: 423777 - DNA, 1898 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcagaggtgaagtgtcaagctgcaggttcaccattcccaaaggcgtcggcagcccccgcaccatcgacgttctgtccccgattggtctgtggggtggccaatccagcacctgccaccagccctccactggggcctgtcctgcttctgcgacagtaaccaggctcaggttttgccgtgcgaaggcagaggtactggttacacctcggcgtctgcaggctgctccctcactgtgcggcctctggtcaaaggccaccaccttcaagcaaccctccatgaaccacagctacattggttcccccatgtcccctgctgtcaccctctatccctgacactgctttatttcccctatctgatgtttctctgtagtgtgttcagatgtatgccccaccttctgcttccccgagagcaggggcttggccatgtcggcctcagtatccccagtacagagaaaggcttagcgcccaggaggccgggccttgggaagagtatgaatggattccctgttacttagaatattcaaaattatattattaacagtgataac

SEQ ID NO: 423778 - DNA, 1604 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggtgatggcccctcaccctggtctttccgagtgtgagcacagctccctcggtgcgtggattctggtccgagccagtgactcccactcgccctgccctgagcatgacacagctcgggctgtcagagggccttgctggggttgccaagagcaggctcgggtggctgtgctgtggtccacagggctctcgccgctggcccctcctctccctgacgtggctcattttgctgctgctgggatgtggactgtggcaaactctcgtgtctggcattagcgccaccccaaaagccgtcagggaaggaagcaacattaaattctagacatttgtcta

SEQ ID NO: 423779 - DNA, 1404 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423780 - DNA, 1791 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaaggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcagaggtgaagtgtcaagctgcaggttcaccattcccaaaggcgtcggcagcccccgcaccatcgacgttctgtccccgattggtctgtggggtggccaatccagcacctgccaccagccctccactggggcctgtcctgcttctgcgacagtaaccaggctcaggttttgccgtgcgaaggcagaggtactggttacacctcggcgtctgcaggctgctccctcactgtgcggcctctggtcaaaggccaccaccttcaagcaaccctccatgaaccacagctacattggttcccccatgtcccctgctgtcaccctctatccctgacactgctttatttcccctatctgatgtttctctgtagtgtgttcagatgtatgccccaccttctgcttccccgagagcaggggcttggccatgtcggcctcagtatccccagtacagagaaaggcttagcgcccaggaggccgggccttgggaagagtatgaatggattccctgttacttagaatattcaaaattatattattaacagtgataac

SEQ ID NO: 423781 - DNA, 2149 bp, Homo sapiens
aacgagaaatatgtacgagtgcggtgcgcgggttgttatttcagtacaggggtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423782 - DNA, 1012 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcaggtgagtgagtgcagggtggccctgggaccagcctgctgagctccagctgcgaggcgggaagtggcctgcgagcagagcccgggatccgctgcagagatgtagattcagtgtgccactcactgtaactcactggttctgatgaggaggcaggccctggcaccttggtgaatagttgcccctcactgcactgggctccctggctgcccctctcggtgcagaggccagctgccacaagggggttggcaagtgtggccaaactttcccttaggaagttcattgagaatgaatatgtagaactagccatttgtataactgagtgatatttgaaacttgcatgtaataaatatttaacctttaaa

SEQ ID NO: 423783 - DNA, 890 bp, Homo sapiens
aacgagaaatatgtacgagtgcggtgcgcgggttgttatttcagtacaggggtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggtaattctagaagatgcacgtgttcactgatgggagataatggggatggggcgctcttagagaaattgcacacccacacgtgacggctttgttttgaataggtttctgttagctgcaattcttgagctgtaatttttgatagtttcttttctgggaaggccccatttgtaagctgagccttgtcgatactgtaatctttaacctttaatgtttaatctttaacatgctgtcctgtcaccctttcccagatgagaaaggtgtctactgagagttccttgaagtagcagtcagtacctgtggagcacttcacagatctagctcagtcaatccttacagaatttgcaaaatatgtcttttaggtcatcaggataacatataatcctggccctttttaaagatgaaaattactttttcattaattactttagttatgaatattcttatttgtttccaatttattcttattgtaatgtagaccattaaattggaggttttggagaagaatttgcttcaagtcagttatatgacagagttacattctgtttttcagacagatgagcaagctaaagtcttacctttcttatttcatgtttatgagagataattaagataaactgtgttaactg

SEQ ID NO: 423784 - DNA, 1791 bp, Homo sapiens
aacgagaaatatgtacgagtgcggtgcgcgggttgttatttcagtacaggggtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcagaggtgaagtgtcaagctgcaggttcaccattcccaaaggcgtcggcagcccccgcaccatcgacgttctgtccccgattggtctgtggggtggccaatccagcacctgccaccagccctccactggggcctgtcctgcttctgcgacagtaaccaggctcaggttttgccgtgcgaaggcagaggtactggttacacctcggcgtctgcaggctgctccctcactgtgcggcctctggtcaaaggccaccaccttcaagcaaccctccatgaaccacagctacattggttcccccatgtcccctgctgtcaccctctatccctgacactgctttatttcccctatctgatgtttctctgtagtgtgttcagatgtatgccccaccttctgcttccccgagagcaggggcttggccatgtcggcctcagtatccccagtacagagaaaggcttagcgcccaggaggccgggccttgggaagagtatgaatggattccctgttacttagaatattcaaaattatattattaacagtgataac

SEQ ID NO: 423785 - DNA, 2538 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423786 - DNA, 1457 bp, Homo sapiens
ctccccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccaaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423787 - DNA, 2637 bp, Homo sapiens
aacgagaaatatgtacgagtgcggtgcgcgggttgttatttcagtacaggggtggggcggggatggaggcggccgtggcgccggggagggatgcgccggcacccgcggcgagtcagcccagcggctgcgggaaacacaactcgccggagaggtgcgcgcctttagggcagggctggggagcggccggcgcctgtcgccgattgtcccgcgcgggaggacgaagggggctcccggcctgtggccgctctcgcgtggggcgtcccgcgcggggatgtccgcgaggtcggcctaagtcagggatgcgagcttcaaggaggagcgggtgcgagctgtggccccgcaagggcccacggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423788 - DNA, 950 bp, Homo sapiens
ggggaacgcccacatagaaccgcccacataggaccgcccacatgggaccgcccacatagaaccgtccacatgggaccgcccacatggcaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgacttg

SEQ ID NO: 423789 - DNA, 306 bp, Homo sapiens
gtagcaatggggtcttactctactgtccaggccggtctcgaactcctggcctcaagtgatcttcccacctagcctcccacagtgctgggattacaggcatgagccaatgcgcctggccaggatcatgattttttaaaaatctctgattttttgaattttacaatttttttttgcattttgcattttgatttgaattttgcaaattttggggtaataaatatgtactgtttctataatcagaaaatatgatccagccccctcttccccacagtacaaaaacatcacctttttccttgaataaaactg

SEQ ID NO: 423790 - DNA, 446 bp, Homo sapiens
cacttggaagcagaaaggcaggttctgagcagccccacaccagcaggtactacctgccataaggtttgtgttgcagccactgcagtcactgctgctgccaccacaactacagttcatagccagtaacagccttcacatgaatgatgtgtagacaccacttttgtctctgaacgcttgacaacaattaggacctgactccaggagcaggacgtcacaggaacaccggaatactggagaaatgaggttagagcaaagaaattagccatctgcctggtgaagactgtgtcctcgaggtagcatttacataggaacaacaggcaacacgtatccattttcattatcctgtgctacagatagacagaggacaaaagggctttaagaaccgtgttttctttaaggcccctgtacttagcgaggctgtatgtccttttttccccttcattcaa

SEQ ID NO: 423791 - DNA, 1799 bp, Homo sapiens
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaagacagcggtttgggttttgtggaggagacgcgttcccgggcgaattccatggagtctgcctcgagtacagattcggaaaatgtgccaggcattgagaaaatttcaggaaggagctctccgtggaacttctcctggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 423792 - DNA, 1975 bp, Homo sapiens
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 423793 - DNA, 1783 bp, Homo sapiens
  misc_feature (1717)..(1717): n is a, c, g, or t
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttgtcttgctctgtcacccaggctggagtgcagtggtacaatcttagctctctgcagccttgacctcctggcctcaagtgatccccctgcctcggcctcccaaagtgccaggattacaggcatgaggccctgtacctggctagaactgcatataattttatagctaaatagagctgtggggaatccatccttcctgaggagaagcagacagaggcggaggagcaggctggtgtcagggctggtgaagcctgctaccgcgctgctcttgagtggcctcaggctaatgaccctccctccttaagccacgctgtccacttctctaaagggggggcctatgagaacatccaagtcacggaagggagtgggggttaaatgagatgtgcacaggtggctaatatgtgcatttttcttccaaccttcctactgtgtgccctaccaccgccacaagccatcaaccaaatagatacctgtcaccgaagacagggtttccttaattttttaacagctctgttgagatataatttacataccataaagttcacctgtttaaagtatacaattcagtggtttttagtatttcatagagttgtgaaaccatcatcctaatctaattttagaacattttgtcacccccaaaagaaaccctgtgcccattagcagtcactccctgttccccttttcccagcctcaggcaaccactaagctancttctgtccctgtagatttgcctttttgaacaccttcataaataaagtcgtatgctttgtggcctg

SEQ ID NO: 423794 - DNA, 5388 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423795 - DNA, 5624 bp, Homo sapiens
tgagacctggagaagttagtattctacttcttgtgctcaagagctatggaaaaagggaggatttaagttagggtgcgatgggaggaaggaagcagagtggaggaggaaagggaacattaagggccagggagaaagcttttgagatagatgagtcaggtttgtattaaggggaggacaaaggcatgataggacttgtttttaactgctagaattgaattttgaagaatttttttaatggactcacttgtcatggccggttacgttttatctgaatggtagtctcttctcagataacaaagctgggctcagtgtttccttgtccatgcatttttaatgttcctctccaccaccctagagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423796 - DNA, 5520 bp, Homo sapiens
ctcggggctccacctagctcagccctggaattccgcaagcacccggaggccggggggtctccgcgggcgtcccatgcggaggacatggtgcgccgtgtcctcttccccacgacctcagggaccggtccccccgccggaactgcttcctacctggtccggtcccggcagctgaatctggccagcccaacctcccggtcgctatggcacccacaggcctaacattcgcgagtccaccttccgccgtccgcgagagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423797 - DNA, 5007 bp, Homo sapiens
gcatcttggcagctctgaattgggaagggatgaaggaggctgtgcctccgggttgcacgaagagtccgagtcatttctcagaaggttttgataggtgggccttagaggagacgccgccggaaaacctgattggcgccctcttggcgatcttcgggcacctcgtggtcagcattgcacttaacctccagaagtactgccacatccgcctggcaggctccaaggatccccgggcctatttcaagaccaagacatggtgctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423798 - DNA, 5101 bp, Homo sapiens
  misc_feature (4930)..(4930): n is a, c, g, or t
  misc_feature (4975)..(4976): n is a, c, g, or t
  misc_feature (4983)..(4983): n is a, c, g, or t
  misc_feature (4985)..(4985): n is a, c, g, or t
  misc_feature (5086)..(5086): n is a, c, g, or t
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccnaactggatctgttattttcagggaaacaggccccagggccccctnnaggcctnancctaagcccttagggctctgagagtgctgttgggttctatttatttatttatttgttcctttgttccctacccgtgcccccagtgtctttcctgctgagtnaccagggggaaaggt

SEQ ID NO: 423799 - DNA, 2746 bp, Homo sapiens
cctcctatctgaatccagatcgccatgatgacaaaaatgagacggatggccttgtacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423800 - DNA, 1801 bp, Homo sapiens
  misc_feature (9)..(9): n is a, c, g, or t
agcggccgncctttttttgcccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423801 - DNA, 2101 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaattaaaaataaataaataaataaaagaacacaaacaggactactctgctagcctgactaaacatagacaaaaaatggacattgtccaaatcatgaaaaacaccaaacatccctctgaccttgctaatgtgagagactgccgcttctttaccaggcacagctttagcttcaatctaggcatcttctaggtaaaagctaagatctccaattatggaattagccctgcttcctgacagcatccaacccaaagcaaagcctcacttccttgaaccctccccaaaaatcacctagtccaagccaaccccacaataactcctttctaaccccctcttacatggttcgtggttccccgccgtgtacacctctctcattgcaatgtgtcaataaacccatatttgttagac

SEQ ID NO: 423802 - DNA, 1427 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtgagttacaaatccttttcctgctgggccctgccattcgggctgcttctcttttgggggcctgatgacgtatgctgtgaagccacaaggaggccagaacatgccccagggcctggcatccagcatggagagaggagctgctaatttgctgagttgtcacctggagggacacctgccactcaaaagacgaaagtttcaccatgttggccaggctgatctcaaactcctgacctcaggtgacccacccgcctcggcctcccaaagtgctgggattacag

SEQ ID NO: 423803 - DNA, 403 bp, Homo sapiens
agaataaaactgctgaacagtctcagtctaaacagaggtgcttttccagccacttggtttccctggtcagcattaggatcttgccttttgtctacctagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaatt

SEQ ID NO: 423804 - DNA, 915 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggcaagggcttttttggggtttgggaatttgtattttcctagcaaggaagttacacagtgctctgcattggctaatagatatgtatggggtctgcatgcctgtcactggtagaaacaggcaggctcttcacacagacaagggaatgtgtaagcaaaagacaagagatgggccgggagtggtggctcacacctgtaatcccagcactttgggaggtgggcgggtcacgaggtcaagagattgagaccattctggccagcatggtgaaaccccgtctctactaaaaacacaaagattggctgggcgtggtggtgcccacctgtagtcccagctactcgggaagctgaggcaggagaatcacttgaaccaaggaggtggaggttgcagtgagctgagatggtgccgctgttatccagcctggtgacagagtgagactctgtctcaaaagg

SEQ ID NO: 423805 - DNA, 5505 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtgacagctgagttcgtgtcttatgtttggctaatacttcctagaattatctagaacagtactgtctagtagaactttctgcgatgatggaagtgttctatgtctatgctgcccaacatgg

SEQ ID NO: 423806 - DNA, 5142 bp, Homo sapiens
  misc_feature (5026)..(5026): n is a, c, g, or t
  misc_feature (5044)..(5044): n is a, c, g, or t
  misc_feature (5052)..(5052): n is a, c, g, or t
  misc_feature (5072)..(5072): n is a, c, g, or t
  misc_feature (5079)..(5079): n is a, c, g, or t
  misc_feature (5084)..(5084): n is a, c, g, or t
  misc_feature (5108)..(5108): n is a, c, g, or t
  misc_feature (5110)..(5110): n is a, c, g, or t
  misc_feature (5134)..(5134): n is a, c, g, or t
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttccaagttggccaatcaaaaggaaggggttccaaggtttattggnaaggtttttggggaaggnctttgggngtttgggacccgcttggggnttaaaanggaangggggagggaggtttggactttcntncccaattggggttttttccttttngggggggg

SEQ ID NO: 423807 - DNA, 4949 bp, Homo sapiens
catgtccactcctgtgaactttccttacaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423808 - DNA, 4557 bp, Homo sapiens
tgtgagtgccacgagacccagtgcacacggcgtctgtcactgtgcaaatctgccggcttgactctgttcctgttccctcccctctgtctccccaagtcctttggggttatagactggctttccggatctaactctctgcatttccctgaggctccccattcacccttgtctcccatctgcaggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggtaggagggagaaacagaaggtgagcagggaggctatttagatgtgtcaaacccgggtgatcattaataatttgggcatatatatgctcccaaacttactctgcccccttccttcccttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423809 - DNA, 1704 bp, Homo sapiens
gcatcttggcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 423810 - DNA, 416 bp, Homo sapiens
cttccctcttccccatctctgcccaggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggtgagcatggagggcagaagattacagggccctgcagctcagagttaatgattttcccccaacaaaggggtgggagtggacaggcctggggagtgtgtccaagatcaatctttggggccacaggtcaattgagcggccagaggaaggacacataaactattcctaagtcttccaaggacagaaagtccagtcacatgagccactgcacccaaccaaatgcagatctcttgacagc

SEQ ID NO: 423811 - DNA, 4354 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423812 - DNA, 4748 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcataaaaaaaccaacaaaacacccaaacccagacgaacagcaaacaacacacaaagaaccaaaaaaaacaaccgcccccacgacacgccaccaaaacaacaacaccagggggggccgccgccccaaagaaaaaacaccgccgtgagtggccgcccaaaagtgccaagatgagtcggtgaccacgacgcgcggcaaatgtgggctaacaaaaaaggcgggggccgatcaaccacagcgggagcacatcacaacggcgcccaacccccgcgccggtaaagacaaagcaacgagcacacaacaccacgaacaagcacaccccagcacacccgcgcaaaaagctaccaaccacaccagccgctggacgccct

SEQ ID NO: 423813 - DNA, 4330 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423814 - DNA, 2821 bp, Homo sapiens
gtctgtcaggcagccctggcccctgcaggtctcctgggggtatgtgttctgggtgcactctctgtgtctttgcccaccaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423815 - DNA, 3874 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagataactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423816 - DNA, 2167 bp, Homo sapiens
gatgtgttgacagatgccaaatacaaagcagctattttttccatgttataatacagattgcccttaacagtttttctgtcgttcgcttgcagtatggaaatagcagttgaaatgagatggaaaacttggtaactttggtttcccaaatgaatcttatgggtaaaagggccaaggtcaggttgaggggacatattggtcaccttcggctagataatacctcattccgcagtaacagacaactccaaaaatctcagtggcttaccacagcaaaggtttatgtctcattcacactacatccactgagggtttgctgtgcctgttctctgccatctgtgccgaaggaacagccgccgtctgggatgtgctggcctcacgtcagcaggataacagcaatggcaggaccacgtgcaggctcttaaagccttacatgattcaccttcactcacatttcattggccaccgcaagtcaagtggttatttgtgacatcactggggcaggaagagtgacaatatcaaggcatatctgattgggagagaccagtgggaaaggacagtaaatatttgaaacagtttatatagtctcacacagggccggtcatttctatgtccttatattgtgctttggttagaaaccaaagagcaagagatgaggtcactggcagctgctcagggccttatggggacagctccttagcagatccctttaccctgggctccttggctctgtagctccagcaacctcatttatttggtcactccactggcctaggtggggagtattaacatgaaggtcatgcatgtgattcaggacaccaccttctaggcagccaaacacttggccatctcaggtgatacccagaggttgcttgatgagcaaggaccagctcagaaccaagcagggaagataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423817 - DNA, 1335 bp, Homo sapiens
gcagccgcctactactactaaattcccggccggtcgacgctgatcatgggcattggtcaccgagtgcagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423818 - DNA, 3440 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcggtgagttgttactctcctaaaaaagtgggatggaggccaggcgcggtggcccatgcctgtaatcacagcactttgggaggccaaggcaggtggatcacttgaggtcgggagttggagaccagcctgaccaacatggagaaaccccgtctctactaaaaatacaaaaaaattagccaggcgtggtggtgcatgcctgtaatcccagctactcaggaggctgaggtaggagaattgcttgaacccgggaagtggaggttgtggtgagccgagattgtgccatggcactccagtctgggcaacaagagtgaaactccatctc

SEQ ID NO: 423819 - DNA, 2165 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgtgagcttcccctccggaaagccttttacgttcgatgctatcttatgaagttcaatgcccttaggaagtttactttttgactcctctatctccctcctaggttgag

SEQ ID NO: 423820 - DNA, 2491 bp, Homo sapiens
  misc_feature (2230)..(2230): n is a, c, g, or t
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtancccggggctccactttcctggctcctgttgtaacgctatccaggacctccaggagtccccaccgcatcgtgggtcctggcgcaccttgggcggccctgacggcatttttcactttgccggggcctcaggaggggcgcgctcactatacccttccttgtcgcgcgcctccggcgtcttcccctgtgtctctcttgggcccgttggcccccctgcacctttccccacgcctcaatccgtctccacccgttcgtcgcccgtttc

SEQ ID NO: 423821 - DNA, 1418 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgcgagaacactagatgtcacccattgctcgcacaaactcacttttgtggcag

SEQ ID NO: 423822 - DNA, 1601 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaaggtaacagttgcaacagtggtgcagtttctggggaaagtggtttggggaaagcagggaaggggccttgaaagcagagtttgagccagagccaagttaccatgagttcccagggtcaggtagggagctcttgccccagggtctcttaaaggggtggagaagacactgggacaggagctgcccatctgcgctgtgtgtctctgggcaagcagctgctacgctgaactataactctcccacctgaagcatgggaggcgaatttctgctttcttccttctcaggaccaatgctttggagcactggctcaatcgatcctttctttctttccttcccttctcttcctttcccttccctt

SEQ ID NO: 423823 - DNA, 406 bp, Homo sapiens
gagagagagagagagagagagagagagagagagagagagagagagagagagagagagagagagagagagagagagagagagagagaggtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423824 - DNA, 327 bp, Homo sapiens
gcttgttggcgtggatgagaaactgaatcctgaggacatcaaaaaacacctgttggtccacgcccctgaagacaagaaagagttgagtgagagggacggtagggaggtggcagttcggatgagaagaccgacaggctctgggcacagactggggagagcagagcggtctcctctctgggagccaggtggtagacacggccctgtcctgaggaagacagctgggtgcagggcggggactggcttggaaccagactgaaatatgccgccagcatccctcacctccttgcccctgtctgtctgacacctctgcctccagcttctcgcctg

SEQ ID NO: 423825 - DNA, 618 bp, Homo sapiens
tgtctggtggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatccaagttcaaattgtggccgggcatggtggctcatgcctgtaatcccagcactttgggaggccgaggctggcggatcacctgagctcaggagttcg

SEQ ID NO: 423826 - DNA, 412 bp, Homo sapiens
ccggaatttgtggatatattttaaaacaactgcaccagggcgtactttctaagtcatctcttactgctgagcgaacctctctgggcttattttgtgcccagtcttttcctttgcaagttaaatagctccaactccttccctctttcttctcttctgttccatttgctaccttcccctgtccattattgctggggcatctctggacccttactggccatccacatccccccaaaatccagtgtacccagtacaagtgtgcttcctaaccctgtacacacttccccaggcctcctcctgatcctgtatcctgatactccctgctctcaacaggtacccgggctccacattcatggatcatgtgttacgctatcaggacactccaggagtcaaaatgattgtggttcttggagag

SEQ ID NO: 423827 - DNA, 607 bp, Homo sapiens
cgcaagtcaagtggttatttgtgacatcactggggcaggaagagtgacaatatcaaggcatatctgattgggagagaccagtgggaaaggacagtaaatatttgaaacagtttatatagtctcacacagggccggtcatttctatgtccttatattgtgctttggttagaaaccaaagagcaagagatgaggtcactggcagctgctcagggccttatggggacagctccttagcagatccctttaccctgggctccttggctctgtagctccagcaacctcatttatttggtcactccactggcctaggtggggagtattaacatgaaggtcatgcatgtgattcaggacaccaccttctaggcagccaaacacttggccatctcaggtgatacccagaggttgcttgatgagcaaggaccagctcagaaccaagcagggaaggtgggtggctctgagggacattccatccaggacttgcttgactttgctcagccagccccagctcctgagcatataacaacatgcctatgtacagcacagagcctctttctaagataatgctagacttgcactccacactcactcattcactctttgagctccc

SEQ ID NO: 423828 - DNA, 4384 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423829 - DNA, 4447 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcataaaaaaaaaacagcggcgaattccaccgcactggcggccgtttctcgtaagtccgagcatatgt

SEQ ID NO: 423830 - DNA, 4316 bp, Homo sapiens
aattcaggaggctggtgttgtgctctagattcatgggccgttgcgccgacgacctgtagaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423831 - DNA, 2885 bp, Homo sapiens
actctctccttatctcaccccagacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423832 - DNA, 1739 bp, Homo sapiens
cttccctcttccccatctctgcccaggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423833 - DNA, 1320 bp, Homo sapiens
ttggcccttcatggagcttctgttctcttcacagggttcctgaaggggccaagcgctttgatggctcttcacctgctggaggatgctcttgagcgtgctgtaaagcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcata

SEQ ID NO: 423834 - DNA, 3061 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggtgagcatggagggcagaagattacagggccctgcagctcagagttaatgattttcccccaacaaaggggtgggagtggacaggcctggggagtgtgtccaagatcaatctttggggccacaggtcaattgagcggccagaggaaggacacataaactattcctaagtcttccaaggacagaaagtccagtcacatgagccactgcacccaaccaaatgcagatctcttgacagc

SEQ ID NO: 423835 - DNA, 4514 bp, Homo sapiens
gccaggcccggggagtgggcacggtggagctgccgaccgttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423836 - DNA, 4514 bp, Homo sapiens
agcggagtggccgtcgaggccgccgtctgttcgaaggctgtccgacttcacggttccccgcggctcggcccgggggcgcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423837 - DNA, 4398 bp, Homo sapiens
gccaggcccggggagtgggcacggtggagctgccgaccgttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgagtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423838 - DNA, 1483 bp, Homo sapiens
tagaggtctcattatattgcccagactggtcttgaactcctgggctcaaacaatcctcctacctcggcctcccaaagtgttgggattacaggcgtgagccactgcgcccagccaggggcctcatctttaaaaggggaatatggcacctgccccacaggattgttgggaggagagcacctggcactagaaaggctcagctcacaggacagttaatgtgctggatggaggtgtacaggaaagacttatctggggggtggtagaggcccaaggacaggcttatgtccagaagcatcccacttatgtccactctccacccagaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423839 - DNA, 1449 bp, Homo sapiens
ctcagcaccagcctcctgcaccggactttgtggagaagggggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423840 - DNA, 461 bp, Homo sapiens
ataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgat

SEQ ID NO: 423841 - DNA, 792 bp, Homo sapiens
gctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgt

SEQ ID NO: 423842 - DNA, 4487 bp, Homo sapiens
gtgaggagggtgaggctcaaagagcagagttcctggagcgcccccagcaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423843 - DNA, 4762 bp, Homo sapiens
agcggagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423844 - DNA, 4676 bp, Homo sapiens
agcggagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgccccacgggcatgggcctgcagagcgtggccgtgaggacgctgagggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgca

SEQ ID NO: 423845 - DNA, 4363 bp, Homo sapiens
gccaggcccggggagtgggcacggtggagctgccgaccgttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgc

SEQ ID NO: 423846 - DNA, 462 bp, Homo sapiens
ctcagagatctcgtcccaatgcccatcagccagtggctccagtggctctgacagcagctgtgtgtcagggcaggccctgggtaggggcctggaggacttaccctgtgtgagtgccatttgccctatacccaccagcccttccccagcccaagctgagcctgtgactgtgaccagcccctccccagcccaggctaggcctttactttgggtagagcttggggtgggtgggccagagccattccccagacacctcctgggtccagagtcagggaagcaggcattcatgcctggcctggccctgcaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggc

SEQ ID NO: 423847 - DNA, 549 bp, Homo sapiens
agcagctgcttaaattcaccagcgcaggagtcctcttcttccaatagaacagaatcctttgtaaattagatttttatattgaaaaagaatatttacacatggttttaggaattccaactgtacaaatgaacatggactcaaagtgtttttatctaatcccaaacctctaactccccagacccctgtttcctacccagaagggaccctcagtgagtgacataatcttccagaaagatgctatacttataaaagcatcaatgcagacctatgctcatcttgctctttttaaaaaatttaatactacattttggagattgtcccgtttccattgacataagctctacctcattcttgtaatggctacattgtactccattatacaaatgtctccgtttctcagcttcatctccctctcccaggaggcactttgccatcttgtatctgctaagatgtccacaccgtcttgtgatagagtctgtgctaagcagagtggtttgtaggctaaaagagcacactccagacccaaaactgcctgcattccagtcctgg

SEQ ID NO: 423848 - DNA, 418 bp, Homo sapiens
cagtaggcaagtctgcagggaagtgatggtcatgatagtggggtctcaagagagaaagagccttgtccttgatctccagacaccagggcaagggctacatgggtggaacaagagggtgtccaacgcagtttgggagaaccagtgcctgaggaccgggtgatggggtgtagctgctgggttcacagttccagggtcttggctgacctccattcctggcccccattctctcagcaatctatgaggcatgtgtcagtcctgggactggttttaccatgcaggtagcttctggaggtgtggtggtagaaagagattctggaaggcagggcagggagaggacacttgtctgtcggtggcacccatggaaatgttgctgaacactgctgagatggagggggagctgggcaaatcagtttttatt

SEQ ID NO: 423849 - DNA, 877 bp, Homo sapiens
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagaattgttcccttcagccgaaacggaggatcaatggggtacttgcagagtggtttgattgtgaccccatggaaaagatgaaattacgttgacaagaatggccagaagatcct

SEQ ID NO: 423850 - DNA, 610 bp, Homo sapiens
agttgccttattttgggaagagttaccagatttaataaggaaattgacaggtttgcatgcctagctagcagaaataatttgtatttttcccattgtgttttccattaaaagcaagatgtgctaaggcagattgtaatataggcttgccttgatttacttaaacacattcacactgccctggattgactttgtccattttttcaactcctcttaacaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423851 - DNA, 1159 bp, Homo sapiens
tgttccaacttcaaacaagtgacctctctttttcccctccctcccacttttttgttgttgtttctaatgccactgtaaccattgcaactattgaaagcgacagcattctctgagtatctaacgtaaatgtagaatttcagttttgcagccctgataattgtaacttcctaaagagtggttgtgaggttcttaggaagtcacaatttcagagttaactattaagtagaagcagttgttaacaaaacccctttagcaaataatgcagcctctgttgctctgtttgtcaaattaattggtatttgattcctttgttgtgtagagaggtctgtcacttccgcattgacacctctccaagagcgcttccctgttagaattttttgtttcctttggactaaacatggagaaactggtaacagttctttcttccttgctcatactttggaaattctgccatactctgaagaacactgaagagtcagtagagccttcagtatattgcagccaagtgaaaaagttgagaaacttactttcttcaaggaatttttatagaataaaatttataattccttataaagaagtaacatttcacactcatattatctctttggggtttagcctatacaaatgttatctgttttcaaaatgttaacttttgtcaaactaggtatggcataacctacagcaataaaatctatgtagggcaaaaaatattttataggtgtctctagttttattactggtgttaattctgtattctaatgtaaaaatttttagtgacatatacctcttatttacatgtgcataccttggaaaattagacaatgttgcatttattcgtggcttttttttttccttccactcagatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423852 - DNA, 430 bp, Homo sapiens
aaatcagaatggagcacatgtaacagttcaaagagtataaatattaggtttctataacatttttacttcttacaaataactaattggtttgctagacttttctatcattgcttgttttagttatataacaaaccactccaaaatgtagtggcttaaaccaactattatttctcatgattctgcagtctgtgctgggctcagcaaggtgtttcttcggttccaggaagtatcttccaaggctggaacatccaaagtggcttcttcactcccatgactaagctggagactagccaggcatccctctgtttacatgttttttccacatgactagcttgggtttcctcacatatagtggtcttagggtggctggacttcttattgcatctggcttccaagaatattttaagatgataagccaaaatgtacaaat

SEQ ID NO: 423853 - DNA, 403 bp, Homo sapiens
tttgccagacttttaatttgtagtatatttagtatgcaatgtttactaaattatttaaatatgaagcataatttgagaactattggtccacaataatggattttttaagcctgtgtttaacttagttgtaagagtcaaatccagctttttccaattttgacttaagtcaattatctacatattctctcctaaaacatttctttaggtaccatgaaagcagtcagatgagttctttggtggagacgtttgtcagtaaagccagtgctttgcagcgccagggaagagctgggcgggtcagagatggcttctgtttccgaatgtacacaagagaaagctttggaggaattatgccttcatattatggtaatctcaagggaactcggatggattttgtccttcgccc

SEQ ID NO: 423854 - DNA, 4750 bp, Homo sapiens
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtaggtatgttttttgttgttgttgtttttaattaactgaatgaactttagaaaaatttaaggtggaaatctttttgttccctgtgaggtaagcagacatttaggaagctctcaattctacatctcaggtttattgtctgatagattatcattatctaataatgccttccatggaaatatttaaataattaacaaacttgagtttaatgttaatggaattctgagttttttttatctgactttgtcaactttatttttttaaaatgcgtttgcttctttgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423855 - DNA, 4676 bp, Homo sapiens
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtaggtatgttttttgttgttgttgtttttaattaactgaatgaactttagaaaaatttaaggtggaaatctttttgttccctgtgaggtaagcagacatttaggaagctctcaattctacatctcaggtttattgtctgatagattatcattatctaataatgccttccatggaaatatttaaataattaacaaacttgagtttaatgttaatggaattctgagttttttttatctgactttgtcaactttatttttttaaaatgcgtttgcttctttgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423856 - DNA, 3956 bp, Homo sapiens
cccttataccaaacagacacaaaagaaggaaaaaagaaaacaataataataaagaaaggacaaataataaaagttcagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtaggtatgttttttgttgttgttgtttttaattaactgaatgaactttagaaaaatttaaggtggaaatctttttgttccctgtgaggtaagcagacatttaggaagctctcaattctacatctcaggtttattgtctgatagattatcattatctaataatgccttccatggaaatatttaaataattaacaaacttgagtttaatgttaatggaattctgagttttttttatctgactttgtcaactttatttttttaaaatgcgtttgcttctttgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423857 - DNA, 3087 bp, Homo sapiens
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtaggtatgttttttgttgttgttgtttttaattaactgaatgaactttagaaaaatttaaggtggaaatctttttgttccctgtgaggtaagcagacatttaggaagctctcaattctacatctcaggtttattgtctgatagattatcattatctaataatgccttccatggaaatatttaaataattaacaaacttgagtttaatgttaatggaattctgagttttttttatctgactttgtcaactttatttttttaaaatgcgtttgcttctttgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaagggtaagctgtcattcaactccacctcagtgaatgatggtgacattactcacctttgcttttgtgatccaaatggaatgtgtaccatatgtgagttttcactgctattggttgatcagtagcacatttcaggcacttttcacattttctttgatagatgtgatagtatgccactgtcctatgagaaggattatcagtagagttctgtcattaaaattctcatataaaagaaaaaatatattaactataataattgaatattcaaatatgttacacactaaattgaacagccaaagaatgtggacaaactcaaattctactaaaatatatctcaagtttttgcaaaccttttctgtggaatatattcctgaatgattttcattaattcttttcagtgagcagaagggaaaaacagtataaattaaaatgttagtattttccaaccccatatttaaaaaaaaaatgagaaaaatacttaaatatctattgtcatgcattttgccatgcaagtatatgcaaaactggccaaaccttaaccagagtgacggcaaagtataggaattagtttaattaattaaactagttagaaccaaatatgacaaattgcaagttcatgtaattctgattatttatactttgaattgttctttctggagatggcatattatatttttatctctaaactgggtaccccttcattaaaagttttctatttagcaaattgtctg

SEQ ID NO: 423858 - DNA, 335 bp, Homo sapiens
attaattgacattttatttatctagatggaagaaagcacgacaagaaggaggttatcgttctgaaatcacatactgccggaggaactttcttaatagaacatcactgttaaccctagaggtaattcttaatatggatctctcactcagagtcatgggtaactataataagttattctggaaaaaagaatgcctaggaaaatacttgtcacatagtaagggcttagtaaacatttgttgaattagtacatttgtgattgtacttctttcttccagcaagtaacttgtacgtattacacagtgatttaaaatagtatttaataatcataatatgttc

SEQ ID NO: 423859 - DNA, 338 bp, Homo sapiens
gacgtttgtcagtaaagccagtgctttgcagcgccagggaagagctgggcgggtcagagatggcttctgtttccgaatgtacacaagagaaagcatagcactggaaatgtaaaacacataaaccagtattgtgtgacatttctgataatatgtatttagtattactttatttttcagatttgaaggctttatggattattctgttcctgaaatcttacgtgtacctttggaggaattatgccttcatattatggtaatctcaagggaactcggatggattttgtccttcgcccctttctagaaaagaaaaaaaatgaacacctaaacttaccttatat

SEQ ID NO: 423860 - DNA, 455 bp, Homo sapiens
gtaaaaaatcttaaagttgcttgctatatgcaaataaattttgttattctttgcagtgtcttctaaagagaaactcttgctaagaactatgattttaactttcagatataaagtgatagctctgcattctattctttcaacccaagatcaagctgcagcattcacacttccccctccaggagtcaggaaggtaaaatttagtacagcaaatttatatgtgatccacctgagagtattttatgatggccgtataactttttatcatcaaagacagttgttaacattaagtgccttatagcgcattgccaactccaagtgttctgcaccttgccatcatcagaagtgaacccaatgttacaattcaagcatttgaatatttacattatgtgctatttaagggagaagacttcattgagggagtgctagttgaaaaacatagtatggatgttgcctgt

SEQ ID NO: 423861 - DNA, 811 bp, Homo sapiens
agggaatagaagaaaattaggtgctctaagtctaggcaaggtttacaaatgcttaacaaatatttgtgtgttttatgtatcatatgcctgtttattttcagcatagtttcttttattttaagatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaaggtaatttgagaattaagcatttaaagttgtataaaatcagaatggagcacatgtaacagttcaaagagtataaatattaggtttctataacatttttacttcttacaaataactaattggtttgctagacttttctatcattgcttgttttagttatataacaaaccactccaaaatgtagtggcttaaaccaactattatttctcatgattctgcagtctgtgctgggctcagcaaggtgtttcttcggttccaggaagtatcttccaaggctggaacatccaaagtggcttcttcactcccatgactaagctggagactagccaggcatccctctgtttacatgttttttccacatgactagcttgggtttcctcacatatagtggtcttagggtggctggacttcttattgcatctggcttccaagaatattttaagatgataagccaaaatgtacaaattcttatcaaactcctgctttattattcttgctaatgtcccattgactgaagtaagtcacatgaccaagcccagagtctgt

SEQ ID NO: 423862 - DNA, 505 bp, Homo sapiens
gacattttatttatctagatggaagaaagcacgacaagaaggaggttatcgttctgaaatcacatactgccggaggaactttcttaatagaacatcactgttaaccctagaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423863 - DNA, 4471 bp, Homo sapiens
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 423864 - DNA, 5009 bp, Homo sapiens
  misc_feature (5009)..(5009): n is a, c, g, or t
agcggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtaggtatgttttttgttgttgttgtttttaattaactgaatgaactttagaaaaatttaaggtggaaatctttttgttccctgtgaggtaagcagacatttaggaagctctcaattctacatctcaggtttattgtctgatagattatcattatctaataatgccttccatggaaatatttaaataattaacaaacttgagtttaatgttaatggaattctgagttttttttatctgactttgtcaactttatttttttaaaatgcgtttgcttctttgtagggttagggtaatcaagtctgaagatgatgtcctgggtagtatgccctacaatcttaacagaagatgggcatgcaagctcagcacctggggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgcaaaaaaaaaataaagcaactcttcccttccccgccctgctctttcccccccccgcaccgtacgcgtgttgaggcatatcccccatacggccttttgccgagccaatagtaacctggggcaccttttttttttttgagagcgcactcttcacccctcgctccgcatgtcctaaccgttggggcgcacgaccacgctacatccatccgccatcctaagaaggcgccgctgctcctatccaacactgatcgagtgaccccagn

SEQ ID NO: 423865 - DNA, 2410 bp, Homo sapiens
gccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacaaaaaaaaaaaaaaaaaaaaaaaaaaaaaaaaaaaaaaaagagagaagagaagaaaaaaaaaaaaaaaaagaaagagagagggaagcccaaaaaaaaaaaaaaaaaaaaagaaaaaaaaaaacagaaacaacaaaaaataagaaaaaaaaaaaaaaacaaaaaaagaaaaaaaaaaaaaaaaaaacaaaaagaaaaaaaaaaagaggagaagaatagggagagagaggagaaaagagggaattgacccccggaaaaaaggagaaaaagggaaaagaaaaagtggggagaaaagggagaaaagaagaaaagagagagaagaaaagacacaacaccaagaagcaataaagggctcaacaaaccacacaagaagccagcgcacaagacaacagccgaagacaaaaagaaaaaaaaaaacaacagaaagaaaagagaaggcaaagcgaggaaggggaagagcccgagaaacaacagagagaaagcagacaagaaaaggagcaggagagagcggcggggaggggataggggagcgcaccaaagagcgcgggaga

SEQ ID NO: 423866 - DNA, 2390 bp, Homo sapiens
  misc_feature (63)..(63): n is a, c, g, or t
gcttctgtgacaaaaaccaagagcaggatgatgacaaacgtggcaagtccacagcgactttcncggattgtggcacacacgccacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacaaaaaaaaaaaaaaaaaaaaaaaaaaaaaaaaaaaaaaaagagagaagagaagaaaaaaaaaaaaaaaaagaaagagagagggaagcccaaaaaaaaaaaaaaaaaaaaagaaaaaaaaaaacagaaacaacaaaaaataagaaaaaaaaaaaaaaacaaaaaaagaaaaaaaaaaaaaaaaaaacaaaaagaaaaaaaaaaagaggagaagaatagggagagagaggagaaaagagggaattgacccccggaaaaaaggagaaaaagggaaaagaaaaagtggggagaaaagggagaaaagaagaaaagagagagaagaaaagacacaacaccaagaagcaataaagggctcaacaaaccacacaagaagccagcgcacaagacaacagccgaagacaaaaagaaaaaaaaaaacaacagaaagaaaagagaaggcaaagcgaggaaggggaagagcccgagaaacaacagagagaaagcagacaagaaaaggagcaggagagagcggcggggaggggataggggagcgcaccaaagagcgcgggaga

SEQ ID NO: 423867 - DNA, 1489 bp, Homo sapiens
gccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 423868 - DNA, 855 bp, Homo sapiens
ctgatagaaatcaggaaatgagccaaaacagcagcaggattctgatctgaggtctgtagggctcctgagcatctgcccgggagcctgggctattgcttctcccttgtgtccccacagctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtaacacgcctgcacctgtcaggcctggagcctggggccacatctcctctgtttcacactgatgacagcgtcagtcccacacggcctttctgccggggaccggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 423869 - DNA, 925 bp, Homo sapiens
  misc_feature (19)..(19): n is a, c, g, or t
  misc_feature (73)..(73): n is a, c, g, or t
gagagagagagagagaganagagagagaggagagagagagagagagagagagagagagagagagaggtaaagnttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacaaaaaaaaaaaaaaaaaaaaaaaaaaaaaaaaaaaaaaaagagagaagagaagaaaaaaaaaaaaaaaaagaaagagagagggaagcccaaaaaaaaaaaaaaaaaaaaagaaaaaaaaaaacagaaacaacaaaaaataagaaaaaaaaaaaaaaacaaaaaaagaaaaaaaaaaaaaaaaaaacaaaaagaaaaaaaaaaagaggagaagaatagggagagagaggagaaaagagggaattgacccccggaaaaaaggagaaaaagggaaaagaaaaagtggggagaaaagggagaaaagaagaaaagagagagaagaaaagacacaacaccaagaagcaataaagggctcaacaaaccacacaagaagccagcgcacaagacaacagccgaagacaaaaagaaaaaaaaaaacaacagaaagaaaagagaaggcaaagcgaggaaggggaagagcccgagaaacaacagagagaaagcagacaagaaaaggagcaggagagagcggcggggaggggataggggagcgcaccaaagagcgcgggaga

SEQ ID NO: 423870 - DNA, 2404 bp, Homo sapiens
aatttgctggaaaatgtacctggagactggatagtcacctgcgcagccgtcgcagtcctggtaaatgtggctgctgcatttttggacagagcatgccacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacaaaaaaaaaaaaaaaaaaaaaaaaaaaaaaaaaaaaaaaagagagaagagaagaaaaaaaaaaaaaaaaagaaagagagagggaagcccaaaaaaaaaaaaaaaaaaaaagaaaaaaaaaaacagaaacaacaaaaaataagaaaaaaaaaaaaaaacaaaaaaagaaaaaaaaaaaaaaaaaaacaaaaagaaaaaaaaaaagaggagaagaatagggagagagaggagaaaagagggaattgacccccggaaaaaaggagaaaaagggaaaagaaaaagtggggagaaaagggagaaaagaagaaaagagagagaagaaaagacacaacaccaagaagcaataaagggctcaacaaaccacacaagaagccagcgcacaagacaacagccgaagacaaaaagaaaaaaaaaaacaacagaaagaaaagagaaggcaaagcgaggaaggggaagagcccgagaaacaacagagagaaagcagacaagaaaaggagcaggagagagcggcggggaggggataggggagcgcaccaaagagcgcgggaga

SEQ ID NO: 423871 - DNA, 1862 bp, Homo sapiens
gccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 423872 - DNA, 1792 bp, Homo sapiens
gccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcggggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 423873 - DNA, 697 bp, Homo sapiens
attccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaacttta

SEQ ID NO: 423874 - DNA, 679 bp, Homo sapiens
attccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttctcacatggccactcaatacctttaagacagcactgtctgtaaaagcatgaagtgcccccttctttattaacacataactgcatttgctgataatatttatttgcctagattcagcccttattggacc

SEQ ID NO: 423875 - DNA, 755 bp, Homo sapiens
aattttttgtggaaacttgaaaaaagatgttaaaatattaacaatgattaacttaatgggaaaaactgcaaatccctcaaaatatttccaaatgattaataattacataatttaaaaattggtggccaagtgtattgtaaactgaaattacacagttttattatgatcatgcctttttactagaaataatgtaccctccatttcaatgtcttatgaaccatacccttgtttccatgcatcagaaattttgcatgtagtttttgtgactcttagaccctaatttattagtaattgctattgtaatgtatacatttcttatcctagaaaaatatatgaaagtactattaagtgctggtatttacataagatatgtatgctcaaatattgataattccaattggaatttagatgtgataaaatgctagaaaaaaaaagttagcaacctcaacttgggtgcttgttctggagtaagctctatgcggaccataagagagaaggatgagaagatgttaaaagcatattaatggggaaatatgcttcagtggttgcagattgaggttgtctgagcacagcctgaagctgtgcaccctgtttctgcatcctgcagcatttttatgtgaatttaaaagtcatcctacttcaaattctttatttcaaactattgagaaattgtcttaatataatgatatttcttaaacaaaatatgttactaccatctgttggaaaattgttgtaataaaaattcaaatctatga

SEQ ID NO: 423876 - DNA, 4388 bp, Homo sapiens
  misc_feature (2015)..(2015): n is a, c, g, or t
ggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctcaggcttgggccaagctgcaggcatctttaacacctgggtccagtaatacaggcagtgacctagaagcattctctgatcacccagccatatagcacagaggcatattttcctgttacttgagtggttcttttagctcatttgctgttacctactcctgtttcccaaagcttatgtaagagcttttccttctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaacacgaatgagcatacagagcaacgcctgttgagccagggagtaggtgacacaaggaaaccttcatggatcttcccttgcctgtcttagtcacagagagaaataagaggaggttgtttgcatcccacaaggcatcgtactagttgggcgagacctaaaattccctgggcacaggttgcacctgggtgtgagcacttaatcactcaacgctttgttttcttacacttgaaaatcaagggaaagantagtaccatctgactcctacactttcattacaagtcagatttttcttaaactagcaggcaaaaacagtacttccaaattttaaggtatggaatgaatgcagtacatctggaattgtagtcgatgaattgcttttttgacttagaagctgaagaaaatagacatagccggcatatctcatggtcaggagctggacgattctggtaacttaggctttttttctctcttcttttgaaacagtgtaacctgttttatgtctaaaaatcttaaggatagtttcagtggttcctgggatgtagtataagttaactctgctgccatcttgtttttttttttttcctttattttgataagtgattattatgcttgataaactttgaattaaatacagttgtcttgagggtatgataagtccacaaaaaattggaaagcatcttacccattttcttcacatcccaaatttttatttgttccatgtcatagtgatgggaagcagttacagagcagcgtcttctgtgtttccttcatgtgttagatattggcaacaaagccagaggtgtaatgttggttatatgaagttcatctcaaaatggagaccatgaccagagtttccagatgatacacgttcttttcagcttcattaaataggcaactatgtttctaaatagtaaagtttcaaaatattctctcaatttaaaatttcatcctcttgaaaatctttgttctttacaaaattatcttaataagttctatatggtcagcttcatcttccttttttttttttttgagatggagtttcgctcttgttgcccaggcggagtacaatggtgggatctcggctcactgcaacctccgcctcctgggttcaagtgattctcctgccacagcctcccaagtagctgggattacaggtgcctgccaccatgcccagctaatttttgtatttttagtagaaatggggttttaccgtgttggccaggctggtctcgaactcctgacctcagttgatccgcctgcctcagcctcccaaagtgctgggcttacaggcctgagccaccacgctcagctcagcttcaccctgtctgcaaagaaaagttttaccaagaccagaagttaaatatgacatttcctaggtagttgtaactctaacatagtttaaaaagtatgtggcttcagattgcctatactttgttcacaaacgtgtgatttagatatgactgatttagaagtgaacaacttggtaacatccctagactccactcatgaacgcagaattattacctgctgtttgctttctgaaagaatttcagaaatcagagcaaatgtgtctttaggcagattcagctccttttaatatttttctcttggcccactctctttgcctcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaacctaaaaag

SEQ ID NO: 423877 - DNA, 816 bp, Homo sapiens
gctgcaggattcggcacgagagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatctttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423878 - DNA, 1050 bp, Homo sapiens
aggattttctcacctaagaatcaaaacttggtaaccatgtttactcactttttatagccaaaaatttagtgatgtgattgctagtttctagaaaaaagtatggtggctcttgcccataatcccagcactttgggaagctaaggccagagcattgcttcaggccaggaattcgagaccagggtgggcagcatagcaagactcaatctctacaaaaaattttaaaaaatcagccaggcatggtggcatgcacctatgttcctagctacttgggatgctgaggcggggggatcacttgagcccagtagttcaaggttacagtgatccatagttgtgccactgcactccagcctaggcaacagagtgagaccctgtgactaaaaaaaaggaaaacaaaatagtcaaagctctttggctatgttttccctagaaattttaattgaagtctaatctagtctccaattctttaattgcctcttccccctccttagcaatactaatttgctgagcaaatcattctaccctttcattgttaattcaaggattatgtctttccaaacaggtgaaaataaattgactatttctgaatccagtattagtgaccggcttgtcacattggagtcctgggctaatgatcctgattatctgaaacgtcaagttggtttctgtgcccagtggagcttagacaatctctgtaagtgggagttgtcctttattaaaatgtccgtttccatttccagactcatttctttcataggctcactggtcttccttttgcaatggtaagtatgagtcctcataaggacctctactggcaggttggatatattctagcagaaaagtatcctagagaccctttagacaagaattacatggtatgcttctaatttcagcattttcctgttcaaaaacctttactggcacccagtttcctgctgcatcaaagcccttaattatatggcactgtctaaccagctctttccaacacaaatcatcccactgtcctacaaacaggtcctgatgattcctacctctggcctattcccctcactt

SEQ ID NO: 423879 - DNA, 4175 bp, Homo sapiens
  misc_feature (569)..(569): n is a, c, g, or t
accgaggaaggggcgtttcctaggggagtgagggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccaggtgagaggcagctatctatctcctggggtggctcctggtaccgatggngtcctgacctactcaggggtgcccgggatagaaagggtagatgaagggacgctttaggagggttctttttgtggagtttacggtctaggtggcacggatgaggcatacctccccggggagatttagaaacgccttgggatagaaagagaatggggctaggaagcaggagctagaactagcggaatgtcctactacggaagccggagctgaaaattggaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423880 - DNA, 3567 bp, Homo sapiens
ttgatatcgaattcggcacgaggggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423881 - DNA, 3901 bp, Homo sapiens
ttgatatcgaattcggcacgaggggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423882 - DNA, 3024 bp, Homo sapiens
aggattttctcacctaagaatcaaaacttggtaaccatgtttactcactttttatagccaaaaatttagtgatgtgattgctagtttctagaaaaaagtatggtggctcttgcccataatcccagcactttgggaagctaaggccagagcattgcttcaggccaggaattcgagaccagggtgggcagcatagcaagactcaatctctacaaaaaattttaaaaaatcagccaggcatggtggcatgcacctatgttcctagctacttgggatgctgaggcggggggatcacttgagcccagtagttcaaggttacagtgatccatagttgtgccactgcactccagcctaggcaacagagtgagaccctgtgactaaaaaaaaggaaaacaaaatagtcaaagctctttggctatgttttccctagaaattttaattgaagtctaatctagtctccaattctttaattgcctcttccccctccttagcaatactaatttgctgagcaaatcattctaccctttcattgttaattcaaggattatgtctttccaaacaggtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423883 - DNA, 1551 bp, Homo sapiens
  misc_feature (569)..(569): n is a, c, g, or t
accgaggaaggggcgtttcctaggggagtgagggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccaggtgagaggcagctatctatctcctggggtggctcctggtaccgatggngtcctgacctactcaggggtgcccgggatagaaagggtagatgaagggacgctttaggagggttctttttgtggagtttacggtctaggtggcacggatgaggcatacctccccggggagatttagaaacgccttgggatagaaagagaatggggctaggaagcaggagctagaactagcggaatgtcctactacggaagccggagctgaaaattggaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataagtaagtatctgactcacggtcacctccagtggaatgaaaagtgttctgcccggaaccatgactttaggactccttcagttcctttaggacatactcgccaagccttgtgctcacagggcaaaggagaatattttaatgctccgctgatggcagagtaaatgataagatttgatgtttttgcttgctgtcatctactttgtctggaaatgtctaaatgtttctgtagcagaaaacacgataaagctatgatctttattaga

SEQ ID NO: 423884 - DNA, 4166 bp, Homo sapiens
  misc_feature (560)..(560): n is a, c, g, or t
ttgatatcgaattcggcacgaggggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccaggtgagaggcagctatctatctcctggggtggctcctggtaccgatggngtcctgacctactcaggggtgcccgggatagaaagggtagatgaagggacgctttaggagggttctttttgtggagtttacggtctaggtggcacggatgaggcatacctccccggggagatttagaaacgccttgggatagaaagagaatggggctaggaagcaggagctagaactagcggaatgtcctactacggaagccggagctgaaaattggaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423885 - DNA, 2462 bp, Homo sapiens
gcctactactactaaattcgcggccgcgtcgacgtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423886 - DNA, 2150 bp, Homo sapiens
agtgcaatggctggccggactgcaatggctggccggagtgcggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggtttttgtttgtttttttgtttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaaatttca

SEQ ID NO: 423887 - DNA, 1593 bp, Homo sapiens
ttgatatcgaattcggcacgaggggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctgtaagtgggagttgtcctttattaaaatgtccgtttccatttccagactcatttctttcataggctcactggtcttccttttgcaatggtaagtatgagtcctcataaggacctctactggcaggttggatatattctagcagaaaagtatcctagagaccctttagacaagaattacatggtatgcttctaatttcagcattttcctgttcaaaaacctttactggcacccagtttcctgctgcatcaaagcccttaattatatggcactgtctaaccagctctttccaacacaaatcatcccactgtcctacaaacaggtcctgatgattcctacctctggcctattcccctcactt

SEQ ID NO: 423888 - DNA, 3115 bp, Homo sapiens
agcgggttccacttgaccgctctaagccgccgcgcagcctgcgttttctccggtacaggttgaggctactaaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaattac

SEQ ID NO: 423889 - DNA, 3239 bp, Homo sapiens
ttcagggaaagacctgtttcctcctgctctttcctctccacggatactctccccaccactaaaagggtttagtataatccttttgtaggccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaattac

SEQ ID NO: 423890 - DNA, 1835 bp, Homo sapiens
ttcagggaaagacctgtttcctcctgctctttcctctccacggatactctccccaccactaaaagggtttagtataatccttttgtaggccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgca

SEQ ID NO: 423891 - DNA, 432 bp, Homo sapiens
caaagaaacttctgcgggtcaggctgctgttgccggtgcagttcccagtacttcctctggggcgtttttcaataaaagccaaacgcccttgctcattttcagggaaagacctgtttcctcctgctctttcctctccacggatactctccccaccactaaaagggtttagtataatccttttgtaggccagaaagcagattttcacttgggaagagacgacccgtagtatgggatgtggtatgataccagcaactggtctattatatcatttaaaccacatggctatctaaagaggtaggtactgtgagtgttctcattttcacgcgaagcagtgttagacattactcattcttgtgttttctttagcttgtctctgacaaattgtggcattcagcttccatggatgtaaaattaaaagatggtataatttgt

SEQ ID NO: 423892 - DNA, 3147 bp, Homo sapiens
ttcagggaaagacctgtttcctcctgctctttcctctccacggatactctccccaccactaaaagggtttagtataatccttttgtaggccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaattac

SEQ ID NO: 423893 - DNA, 2295 bp, Homo sapiens
  misc_feature (548)..(548): n is a, c, g, or t
ggagagtagggtgcagggagggtaccttacgaaacagcgcacttcgggccctgcacgctacctcatttccctaatagggatgaaaagctcaggcctctggtagcttccagctgacgccagtgctctctccacaccccttttttgacaggattatccggggttgaacgctgtgtcacaaatacgaattcccgcgaccacgtctaagtggtctaacaatcaatcaagcatcttttacaaaaccaaacccttcccccatcccgttccctccatctctctccctagccaaacaaacctaggagagtcctcaagatggattttcacaaatcctgcagcgcactaactgggaggaagaaacgatacagaaaataagagtgtcggccatccccctctctgcaaccgaaattacaggctccatttcctgtccccttgggaactgcaaaatcctctgctgaaaaccggacgcctcccagcccctccaggccggcgcacgcggccgccgcgctcccccttcccgggccccgtgggcgccagggggcggcggggacccncggcgccctcccctccccctccccgcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcggtgccttcttctcctcagtccggaccttcttggcggacagagaacccggagggtcccgggaggagagttgcagcttgccaaacggttctttctccgagacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggcttcaccaggtactgccttctaacgagctggccatttccacatgtcagataggaccaacttgccttttaactacccgtgtgatacttaaacactgttgccggtatcacagcttttcttcaaaacaggaagcaacgagaatgagggcattccagtagcaggagacagcatgcatagagatgctgatgaagaaagagcctagcgcacgtgggaaactgcaaaagttcagactggttggaatgctggaaatgttgtgaatgacaggagatgaggctggcgagaaaacagaggtcagattgtggaaggctgtcaagccaaagactttgattttattcttgagattgatgagatgtgtgtaatccaggagtgtgcaaaacaatctgtaagggttcagaaaacatactgcttctatatatagttacctttgtcttaacttgaaaatttcaaattgtgtaggagttacaatgtgtgtaattgttattatagtactggatccaaataatttataaataaataaatatagacataatatggtgtattacaggttaaat

SEQ ID NO: 423894 - DNA, 2674 bp, Homo sapiens
  misc_feature (548)..(548): n is a, c, g, or t
ggagagtagggtgcagggagggtaccttacgaaacagcgcacttcgggccctgcacgctacctcatttccctaatagggatgaaaagctcaggcctctggtagcttccagctgacgccagtgctctctccacaccccttttttgacaggattatccggggttgaacgctgtgtcacaaatacgaattcccgcgaccacgtctaagtggtctaacaatcaatcaagcatcttttacaaaaccaaacccttcccccatcccgttccctccatctctctccctagccaaacaaacctaggagagtcctcaagatggattttcacaaatcctgcagcgcactaactgggaggaagaaacgatacagaaaataagagtgtcggccatccccctctctgcaaccgaaattacaggctccatttcctgtccccttgggaactgcaaaatcctctgctgaaaaccggacgcctcccagcccctccaggccggcgcacgcggccgccgcgctcccccttcccgggccccgtgggcgccagggggcggcggggacccncggcgccctcccctccccctccccgcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcggtgccttcttctcctcagtccggaccttcttggcggacagagaacccggagggtcccgggaggagagttgcagcttgccaaacggttctttctccgagacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggcttcaccaggtactgccttctaacgagctggccatttccacatgtcagataggaccaacttgccttttaactacccgtgtgatacttaaacactgttgccggtatcacagcttttcttcaaaacaggtaatattagggacacttgaaatttgggaattagatttacctttgctgttactaaataattgttagaattttaaatgtcatattcattttactcaactaatctctttagctttcctatttatattcctacttatgattacgtgtaattctcattggaaggattaaaatattttgaaagtaagacagtaaaattgtgaaatactttggtattggttacaaaacagtacttaggtaccttcttcctgattttctgtatttttaaaaaataaggccaggcacagtggcaaatgcttatattcccaactgcccagtaagctgaagcaagagaattgcttgagcccaacctgggcaacatagtgaaaccccagtcaccaattaaaaacaaacaaacaaaaagagtatattttttgaagatattttatcacatatacagaagcaaacaaagaggggaaggaattgtttaaaataatgttaagctaaataaagtcaaagaaaatttaagtaatagttaatagttattgttatagaagacatcaatttactaccccgttctcaaaaaggaaaatctgcaagtagactgtagtgctagagtaagcttttccttaatttcagaaagcctgtattaagcatttactttatgccaaactccattttagggactggaaatataaaataaataaaacacagtccctgctctcagtgaacttgttgtctagggaatgttaagtagaaccacctgaaattgcattgtttttgtaagccagctatcggttccacctgacattatatgtggaaacagaaa

SEQ ID NO: 423895 - DNA, 566 bp, Homo sapiens
caataataaagatatgaccacggtgctacggggcactgacaaaatgcttcatgctgcccagggcagtcagtgaaggctccccaggggagatgacgtttgagccgagtttcagaagatgattggagtttaccacgtgttcacaggaagcaacgagaatgagggcattccagtagcaggagacagcatgcatagagatgctgatgaagaaagagcctagcgcacgtgggaaactgcaaaagttcagactggttggaatgctggaaatgttgtgaatgacaggagatgaggctggcgagaaaacagaggtcagattgtggaaggctgtcaagccaaagactttgattttattcttgagattgatgagatgtgtgtaatccaggagtgtgcaaaacaatctgtaagggttcagaaaacatactgcttctatatatagttacctttgtcttaacttgaaaatttcaaattgtgtaggagttacaatgtgtgtaattgttattatagtactggatccaaataatttataaataaataaatatagacataatatggtgtattacaggttaaat

SEQ ID NO: 423896 - DNA, 1097 bp, Homo sapiens
agcggccgctcgcgatctagtctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggcttcaccaggtactgccttctaacgagctggccatttccacatgtcagataggaccaacttgccttttaactacccgtgtgatacttaaacactgttgccggtatcacagcttttcttcaaaacaggtaatattagggacacttgaaatttgggaattagatttacctttgctgttactaaataattgttagaattttaaatgtcatattcattttactcaactaatctctttagctttcctatttatattcctacttatgattacgtgtaattctcattggaaggattaaaatattttgaaagtaagacagtaaaattgtgaaatactttggtattggttacaaaacagtacttaggtaccttcttcctgattttctgtatttttaaaaaataaggccaggcacagtggcaaatgcttatattcccaactgcccagtaagctgaagcaagagaattgcttgagcccaacctgggcaacatagtgaaaccccagtcaccaattaaaaacaaacaaacaaaaagagtatattttttgaagatattttatcacatatacagaagcaaacaaagaggggaaggaattgtttaaaataatgttaagctaaataaagtcaaagaaaatttaagtaatagttaatagttattgttatagaagacatcaatttactaccccgttctcaaaaaggaaaatctgcaagtagactgtagtgctagagtaagcttttccttaatttcagaaagcctgtattaagcatttactttatgccaaactccattttagggactggaaatataaaataaataaaacacagtccctgctctcagtgaacttgttgtctagggaatgttaagtagaaccacctgaaattgcattgtttttgtaagccagctatcggttccacctgacattatatgtggaaacagaaa

SEQ ID NO: 423897 - DNA, 1340 bp, Homo sapiens
ctgtgatcctatttattactgatgacagtcaaacagtattaagtgtctacaatgggcccagcactgtgtgacaatgtaattaataatataatgagattagtaagcaaagaacatggggaaagactttctaggctgaggaacaagcatttggaaagagatgagagtaatgacacactcaatgtggtattgtttatgagaagttcattgtggttcaaggataagggacacgaagtgccgtaaaaggagagggctctctaaaatgggtgagagccagattgtgtaaagtgttgctcttgactgccttggcatgctgaggagtcagtaaataccttttgttaacttaagggctttaatgaggaagagtgaaaaatgtttacgtaaccattttgacttcctgctcattcctcacaggcttcaccaggtactgccttctaacgagctggccatttccacatgtcagataggaccaacttgccttttaactacccgtgtgatacttaaacactgttgccggtatcacagcttttcttcaaaacaggtaatattagggacacttgaaatttgggaattagatttacctttgctgttactaaataattgttagaattttaaatgtcatattcattttactcaactaatctctttagctttcctatttatattcctacttatgattacgtgtaattctcattggaaggattaaaatattttgaaagtaagacagtaaaattgtgaaatactttggtattggttacaaaacagtacttaggtaccttcttcctgattttctgtatttttaaaaaataaggccaggcacagtggcaaatgcttatattcccaactgcccagtaagctgaagcaagagaattgcttgagcccaacctgggcaacatagtgaaaccccagtcaccaattaaaaacaaacaaacaaaaagagtatattttttgaagatattttatcacatatacagaagcaaacaaagaggggaaggaattgtttaaaataatgttaagctaaataaagtcaaagaaaatttaagtaatagttaatagttattgttatagaagacatcaatttactaccccgttctcaaaaaggaaaatctgcaagtagactgtagtgctagagtaagcttttccttaatttcagaaagcctgtattaagcatttactttatgccaaactccattttagggactggaaatataaaataaataaaacacagtccctgctctcagtgaacttgttgtctagggaatgttaagtagaaccacctgaaattgcattgtttttgtaagccagctatcggttccacctgacattatatgtggaaacagaaa

SEQ ID NO: 423898 - DNA, 387 bp, Homo sapiens
aattaaaaaattgcaatgtacttgaatttcctcaggtatcaccagtctgtgggtacaaaaggagagtaacatgaacgattcaaattccactggctcttgttcccatggattcacagaagttcagccccatttcaaaacttcacatttgcttctgggaagcccattctggaaagtttctctgtggccctctccagaaggcagcgcgacttccacccagcaacacaagtctctgcagcacctgccccagcagcgccagctgagccccggaagctgggaaggcttaagctgactcttctgctgcacatagcaacacggtctctcatgagagaccgtgttacaatgagttaaatgttctctgcctagatcacgaagaagccaggaaggcca

SEQ ID NO: 423899 - DNA, 3417 bp, Homo sapiens
  misc_feature (548)..(548): n is a, c, g, or t
  misc_feature (2706)..(2706): n is a, c, g, or t
ggagagtagggtgcagggagggtaccttacgaaacagcgcacttcgggccctgcacgctacctcatttccctaatagggatgaaaagctcaggcctctggtagcttccagctgacgccagtgctctctccacaccccttttttgacaggattatccggggttgaacgctgtgtcacaaatacgaattcccgcgaccacgtctaagtggtctaacaatcaatcaagcatcttttacaaaaccaaacccttcccccatcccgttccctccatctctctccctagccaaacaaacctaggagagtcctcaagatggattttcacaaatcctgcagcgcactaactgggaggaagaaacgatacagaaaataagagtgtcggccatccccctctctgcaaccgaaattacaggctccatttcctgtccccttgggaactgcaaaatcctctgctgaaaaccggacgcctcccagcccctccaggccggcgcacgcggccgccgcgctcccccttcccgggccccgtgggcgccagggggcggcggggacccncggcgccctcccctccccctccccgcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcggtgccttcttctcctcagtccggaccttcttggcggacagagaacccggagggtcccgggaggagagttgcagcttgccaaacggttctttctccgagacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggtatcaccagtctgtgggtacaaaaggagagtaacatgaacgattcaaattccactggctcttgttcccatggattcacagaagttcagccccatttcaaaacttcacatttgcttctgggaagcccattctggaaagtttctctgtggccctctccagaaggcagcgcgacttccacccagcaacacaagtctctgcagcacctgccccagcagcgccagctgagccccggaagctgggaaggcttaagctgactcttctgctgcacatagcaaaaaatggtcatttctgtagttgcagctccagatctacaataatcaatctatatccatattttatggggtttttttgagacaaagtcttgctctgttactcaggctggagtgcagtggcattatcatcattcacttgtagccttgacctccctggctcaggtgatcctgtcacctcagccttccaagtagctgagaccacaggcatgcaccactaagcctggctaatttttcaatttttatttttcgtagagacagggtctccctgggttgcccaaactggtcttgaattcctgggctcaagcaatcctcctgtcccggcaccccgaagtgttgggactacaggcatgagccactgtgcacagccctttttgtttttgtttttgtttttgtttttttttaaaggtaatttcccagtggaatcctcgagatttcttcatgtttttggaaaaatgagttacattttagattgttttcctttttggaatttaatggtatacattatattacatagctatgttgagctctatttctattacactaaaaagtaggctaattgtcttaactttcatcagtaatgacattaaatgtgtgaagattatacttggaataaagcacttggattcattcatttcttcagtaaatatttattgagcactagtatgttccaacgagtgtctgtctacatnctggggacaagtgataactaaatccctgtcctcgtggagagttaacaatcaacaaactaacaaacatttaatttatgtcatcaactcatttccacaaatataacaacatcttgacttcaagtttcctgagtttctggtctaaagaattgctaccttcaagagctcaaatcatttgttggggagagaggcctgtgatatattttctcctttacaatgaaagtagctgtaaaaagaggaagagaaattctgagggtaaagataaaaaatgttgaaatcttctttctggatttcagattgagtctcttgccctaattgatgcaatttacactccatgcatctccttccctggaccttctccagttcttggggactacagatgaacttacttttaatgcattttatggcatttggaggccctccagtggacaaatactatacctgaaaaaaatccttttgctgtgctaaagtgttcaggtgtgaagtgtactcatgtttgcaaatcactttgaaatatataaacaaaaatgaattaatggatgaatagagtgatgcatagatcattagacatgtgataaaaataactgttaattgtagaatctagatgatgagtatattatatgatatggcccactgtataattctttcaacttttctgtttgaatgtttgataataaaatattgaataaaaatctttttgctaaagaaatatgc

SEQ ID NO: 423900 - DNA, 2242 bp, Homo sapiens
  misc_feature (548)..(548): n is a, c, g, or t
ggagagtagggtgcagggagggtaccttacgaaacagcgcacttcgggccctgcacgctacctcatttccctaatagggatgaaaagctcaggcctctggtagcttccagctgacgccagtgctctctccacaccccttttttgacaggattatccggggttgaacgctgtgtcacaaatacgaattcccgcgaccacgtctaagtggtctaacaatcaatcaagcatcttttacaaaaccaaacccttcccccatcccgttccctccatctctctccctagccaaacaaacctaggagagtcctcaagatggattttcacaaatcctgcagcgcactaactgggaggaagaaacgatacagaaaataagagtgtcggccatccccctctctgcaaccgaaattacaggctccatttcctgtccccttgggaactgcaaaatcctctgctgaaaaccggacgcctcccagcccctccaggccggcgcacgcggccgccgcgctcccccttcccgggccccgtgggcgccagggggcggcggggacccncggcgccctcccctccccctccccgcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcggtgccttcttctcctcagtccggaccttcttggcggacagagaacccggagggtcccgggaggagagttgcagcttgccaaacggttctttctccgagacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttctggccatttccacatgtcagataggaccaacttgccttttaactacccgtgtgatacttaaacactgttgccggtatcacagcttttcttcaaaacaggaagcaacgagaatgagggcattccagtagcaggagacagcatgcatagagatgctgatgaagaaagagcctagcgcacgtgggaaactgcaaaagttcagactggttggaatgctggaaatgttgtgaatgacaggagatgaggctggcgagaaaacagaggtcagattgtggaaggctgtcaagccaaagactttgattttattcttgagattgatgagatgtgtgtaatccaggagtgtgcaaaacaatctgtaagggttcagaaaacatactgcttctatatatagttacctttgtcttaacttgaaaatttcaaattgtgtaggagttacaatgtgtgtaattgttattatagtactggatccaaataatttataaataaataaatatagacataatatggtgtattacaggttaaat

SEQ ID NO: 423901 - DNA, 961 bp, Homo sapiens
ctgtgatcctatttattactgatgacagtcaaacagtattaagtgtctacaatgggcccagcactgtgtgacaatgtaattaataatataatgagattagtaagcaaagaacatggggaaagactttctaggctgaggaacaagcatttggaaagagatgagagtaatgacacactcaatgtggtattgtttatgagaagttcattgtggttcaaggataagggacacgaagtgccgtaaaaggagagggctctctaaaatgggtgagagccagattgtgtaaagtgttgctcttgactgccttggcatgctgaggagtcagtaaataccttttgttaacttaagggctttaatgaggaagagtgaaaaatgtttacgtaaccattttgacttcctgctcattcctcacaggcttcaccaggtactgccttctaacgagctggccatttccacatgtcagataggaccaacttgccttttaactacccgtgtgatacttaaacactgttgccggtatcacagcttttcttcaaaacaggaagcaacgagaatgagggcattccagtagcaggagacagcatgcatagagatgctgatgaagaaagagcctagcgcacgtgggaaactgcaaaagttcagactggttggaatgctggaaatgttgtgaatgacaggagatgaggctggcgagaaaacagaggtcagattgtggaaggctgtcaagccaaagactttgattttattcttgagattgatgagatgtgtgtaatccaggagtgtgcaaaacaatctgtaagggttcagaaaacatactgcttctatatatagttacctttgtcttaacttgaaaatttcaaattgtgtaggagttacaatgtgtgtaattgttattatagtactggatccaaataatttataaataaataaatatagacataatatggtgtattacaggttaaat

SEQ ID NO: 423902 - DNA, 6392 bp, Homo sapiens
  misc_feature (12)..(12): n is a, c, g, or t
caaagctcttgnctcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgaga

SEQ ID NO: 423903 - DNA, 497 bp, Homo sapiens
cccagtgccgagtagggccttgttaagaaaccgcttatcactaaatgatctgtcttccagctctacaatggcaagaatctgggacttactgtttatactgtttactttgcagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggaggtaactgatttaaagtacttcatagctttcatactgacccacataagccattacaaagtggcagaacttttactgatagtggtgcttttagagcagaactttacccagtaataaagcaaatattgagaaa

SEQ ID NO: 423904 - DNA, 6338 bp, Homo sapiens
  misc_feature (12)..(12): n is a, c, g, or t
caaagctcttgnctcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgaga

SEQ ID NO: 423905 - DNA, 5005 bp, Homo sapiens
  misc_feature (12)..(12): n is a, c, g, or t
caaagctcttgnctcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataata

SEQ ID NO: 423906 - DNA, 4429 bp, Homo sapiens
agcatataggaagatatgagtgtgagcgaatactagattcctagaagtgagatgtaaatgctagtataatattaatgtaaatgaggggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgaga

SEQ ID NO: 423907 - DNA, 2484 bp, Homo sapiens
gtttcttttgggattgattaaggataagatgtttgttcctagcacattatttaaatgatctctagtgtcttttggcttttgcaaatgcaccatattttccattttttatttctaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgaga

SEQ ID NO: 423908 - DNA, 4073 bp, Homo sapiens
  misc_feature (12)..(12): n is a, c, g, or t
caaagctcttgnctcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaaggtaaaagagacaggaaaaaaaatcattcccatttaaggacatttgttccatgatccaagtatttgtgaatagcttttgtgtagactattagcattcttggctatccaggaacttggctatccataaatccaaaagcacttttgtcgacttctgcaagagatgtgaatggaccaaataatttatttccttcatttcattcattaatattaatttaagtaacttataatctaaaggcttcttttcattgtcccttctcctttcttcatgtccccaaaagatatacagttaatataattttaaaatctaaaaataaagtgaacaagaggagaacacaccaattcttacttcataaaggatgcaggccccatctcatagttacccccaaatgtcctc

SEQ ID NO: 423909 - DNA, 301 bp, Homo sapiens
acaaagaaatgaacagttgaacaatattggaaagccgtggtcaacatttaaagtttacttttgaaatgactattcttcaaaaataattggtcaatgttctttctgattttagggcatatcaagagaggagatttctttcacaactcatccagaagtttatctctgtgctgaaatcagtcccactttctggtatcttcttttttactcagtgcatttgtgaaattatcatatagctgcccctatggtatttactcatctctaatctaaaaactgttcttggaatgattttaaattgtattgg

SEQ ID NO: 423910 - DNA, 421 bp, Homo sapiens
gcttaagcatggagtgttgattttggggttacaaatacatttttattagtatatgaatttgcaagtacaaaatctgtagataataaggatggagtcttttttaaagcattgaacttcttaatatcaaaatattaacttgaaaatatttgtggcatgttttccctccaggacttaaaaaggcagtatacttcttatgtaaagacttaggtagaaatgctggtatgtttataaacttattttcttcatgccctaaacaggaagtagacttgatacgaagtcaagtacagcagcttatctccctcccaatgtggatgggcttacagctggtaagtctctaatttcagagtcttatgaatgtatgtgttataagtagaacgtgtggttttagtctatagccttaagcggatcagcgagtcctagc

SEQ ID NO: 423911 - DNA, 2713 bp, Homo sapiens
  misc_feature (534)..(534): n is a, c, g, or t
  misc_feature (804)..(804): n is a, c, g, or t
  misc_feature (1956)..(1956): n is a, c, g, or t
gagacagagtctcgctctgtcgcccgggataccgatctaggctcactgcaagctccgtctcccaggttcactccattctcctgcctcaacctcccgagtagctgggactacaggcgcccgccaccacgcccagctaatttttgtatttttagtagagatggggtttcaccgtggtagccaggatcgtctcgacctcctgacttcgtggtctgcctgcctcggccttccaaagtgctgggattgcaggtgtcagccacgaccacgcccggctaaccccagccctttctaagagcagaaaaatggatagatttgatgagagaatcttatgagaatggtacatgaatttggatgtaaaatcagttacaaattaaagaggtctttaaagcaatgaataaataaacacagccctgttaggctattaggaggccattggcaatgagaaaaattaaatattgaattaatgtataagtatttctgtatttttgttattcctgtgcggtacagagttttaatttgaaagtaatgataatcagnttctaggattgagtttcccagaaaaatgattaatagaaataaaaaattctcaagtttaactagtgatttttcatatttgttcagaaaattaaaagatatatttattgatgtaattaccaagaaaatacttacaggtaaaaaattaattgctacattttaactatagtatggttaatattacgtgaaaaatacatgaacggcactagaaaaaatatgccaataatcacagtcattgcctctagctagtggggttagatattatttcctganttttgtattttatataattttcaaatttgtagaattagccaagttgttttaatctgaaaaattgattaaataaaaattgatatgtatccagagtcatctatgttgattttttgaaaaatccatttaaattttgttatctttaatttgatgttttaccatatagttagaataaactgaatattttcacggttcaactttcagatcagttgagtaacaatattgatttgagatattcatttctgttaaaactttatgtaaaagactaggggagggatagctttaggagaaatacctaatgtagatgacaggttggtgggtgcagcaaaccactatggcatgtgtatacctatgtaacaaacctgcatgttgtgcacatgtatcccagaacttaaagtataataatttaaaaaatttacatatttttagaggttaaaattaatgtgtcttttaacaatcttactaaataaatagctatcaccatataattttataactgttactgcccacaaccataaaattaattatgataacctttacataatatagagtttctcattagtgtctggtgtagcattagactggcttcagtctttaactactggatttcatcaagtcatgattccattgattaaaaatacctgatgattacagaatgttaaaataaaattcagtagttgaatgatattatttctatcacttcaattctttgattgtttttatgtatataagaaatttgtggctgggagcagtggctcactcctttaatcccagcattttgggaggctgaggtgggaggatcctttgagcgcaggagttccaggctgcagtgagctgtgatcattccactacactccagcctggcaacagagggataccctgtctcaaaaataaataaataaataaataaacaaaaacaaaaagaaaagaaaaatttgtatgatacaaactcttaagtcaatttatatactaaaattctgataattccgttgtataaataagaatatagagacacacgtgttgattaacttcaaacagccgtccacacatttgttgaacatcatgcatttgcactctgtgctctttattctgtttatcctatattcatgcaggttaccaaagaagatgactttgcttacataaactctccaggtngatacattttactaagaagtttgcgtgaataattatatacccaaagtgttacaacccttggagagcctcagaatgaagccttaggcttagagacacaaagaaacaggtgtaaaatgcattttcttttccatcacatcaagggatttacctgatgtttggaaggaagatactattccatactttgttttcttaaatttcctctctgacaaatttccttactgaaatcaaaatcttactaattgtttttctcatttattgtttcagccagccaagccagggacttgttgtcaaagatgctagtgattgacccagcaaaaagaatatcagtggacgacgccttacagcatccctacatcaacgtctggtatgacccagccgaagtggaggcggtaagaaataggctgcctttactttgcttccacaaacaaatcatagctcatagcaaaaactgaataggactagaagcctaaagaatgcacaatggatttttataaaatttctaagtccaaagcctattatctgcccctctaaaagctattttcttcaacatatgttttaaatacatttttttcaggacttactagaagagggtatgatttagccctacaaaccttagatgtccatgatacactaccatttgtttctgttaaattgccaatacttgtgtttcttcttgtgtgtttgactgccagtctcttctaatgcaaacttagtggtaggaaacaacagaggacaagttgcttagcttgtatttttt

SEQ ID NO: 423912 - DNA, 493 bp, Homo sapiens
ggagaagaaagcctctcatggactcagatgtggcatcgataaacaccggtgtttatcgatgccacggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 423913 - DNA, 742 bp, Homo sapiens
  misc_feature (655)..(655): n is a, c, g, or t
  misc_feature (707)..(707): n is a, c, g, or t
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggtgtgtgttccttacaggtaaaacaagatcacttaatttttggtttcctgtccaagnaacataagttcctataagtccactctattctttgagggtcttagtgcatttncaatgaatgtgccaccatatccgtgcaatcttagg

SEQ ID NO: 423914 - DNA, 478 bp, Homo sapiens
tatgttctccttgcactaggttcaaaccactaggacagcatttgccacattattgttccactaatgaaccacctcagtggctagtgtgagaaacaccaacagcaggcccatctcagatcttcactatggcaacttatgcaagaaactgttgaattagacccgtttcctatagatgagaaaccatacaagctgtgaatgtcaagatgttgtcatgaagagagagagagagacagactctcagtctttgctaccagtgtctgaacttatcggtacatagttatcttgccggtagccccacattccaggtggtggaaaagcaaatatgcgaatcaagttccagaaataatcaatcttgatgatcccattgcttttaagagagacatgcaaggaatgctctacaaatatagcacatggaatgtggaagctgctctataaataataaatattttgtattgttctacaactttttcataaatca

SEQ ID NO: 423915 - DNA, 4036 bp, Homo sapiens
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataagaatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 423916 - DNA, 3845 bp, Homo sapiens
ctcaaggacccctgtgaggccaggcagaaatggcgtggcaggggacccagcgagcccagagggattttgccgctgcttcctctacccctgtatttcacgcagctctctaaattgactcagctccagaaccataattatcatgtgatctagacctgatacattgtagatgaagaaacatgtcgacagagccactatctgcccaacatctgatgggtagtcatagtcacagtggaactgagactaaggtttccatttttatttgactatgcttcttcccaaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaattacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataagaatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 423917 - DNA, 4740 bp, Homo sapiens
  misc_feature (534)..(534): n is a, c, g, or t
  misc_feature (804)..(804): n is a, c, g, or t
  misc_feature (1956)..(1956): n is a, c, g, or t
gagacagagtctcgctctgtcgcccgggataccgatctaggctcactgcaagctccgtctcccaggttcactccattctcctgcctcaacctcccgagtagctgggactacaggcgcccgccaccacgcccagctaatttttgtatttttagtagagatggggtttcaccgtggtagccaggatcgtctcgacctcctgacttcgtggtctgcctgcctcggccttccaaagtgctgggattgcaggtgtcagccacgaccacgcccggctaaccccagccctttctaagagcagaaaaatggatagatttgatgagagaatcttatgagaatggtacatgaatttggatgtaaaatcagttacaaattaaagaggtctttaaagcaatgaataaataaacacagccctgttaggctattaggaggccattggcaatgagaaaaattaaatattgaattaatgtataagtatttctgtatttttgttattcctgtgcggtacagagttttaatttgaaagtaatgataatcagnttctaggattgagtttcccagaaaaatgattaatagaaataaaaaattctcaagtttaactagtgatttttcatatttgttcagaaaattaaaagatatatttattgatgtaattaccaagaaaatacttacaggtaaaaaattaattgctacattttaactatagtatggttaatattacgtgaaaaatacatgaacggcactagaaaaaatatgccaataatcacagtcattgcctctagctagtggggttagatattatttcctganttttgtattttatataattttcaaatttgtagaattagccaagttgttttaatctgaaaaattgattaaataaaaattgatatgtatccagagtcatctatgttgattttttgaaaaatccatttaaattttgttatctttaatttgatgttttaccatatagttagaataaactgaatattttcacggttcaactttcagatcagttgagtaacaatattgatttgagatattcatttctgttaaaactttatgtaaaagactaggggagggatagctttaggagaaatacctaatgtagatgacaggttggtgggtgcagcaaaccactatggcatgtgtatacctatgtaacaaacctgcatgttgtgcacatgtatcccagaacttaaagtataataatttaaaaaatttacatatttttagaggttaaaattaatgtgtcttttaacaatcttactaaataaatagctatcaccatataattttataactgttactgcccacaaccataaaattaattatgataacctttacataatatagagtttctcattagtgtctggtgtagcattagactggcttcagtctttaactactggatttcatcaagtcatgattccattgattaaaaatacctgatgattacagaatgttaaaataaaattcagtagttgaatgatattatttctatcacttcaattctttgattgtttttatgtatataagaaatttgtggctgggagcagtggctcactcctttaatcccagcattttgggaggctgaggtgggaggatcctttgagcgcaggagttccaggctgcagtgagctgtgatcattccactacactccagcctggcaacagagggataccctgtctcaaaaataaataaataaataaataaacaaaaacaaaaagaaaagaaaaatttgtatgatacaaactcttaagtcaatttatatactaaaattctgataattccgttgtataaataagaatatagagacacacgtgttgattaacttcaaacagccgtccacacatttgttgaacatcatgcatttgcactctgtgctctttattctgtttatcctatattcatgcaggttaccaaagaagatgactttgcttacataaactctccaggtngatacattttactaagaagtttgcgtgaataattatatacccaaagtgttacaacccttggagagcctcagaatgaagccttaggcttagagacacaaagaaacaggtgtaaaatgcattttcttttccatcacatcaagggatttacctgatgtttggaaggaagatactattccatactttgttttcttaaatttcctctctgacaaatttccttactgaaatcaaaatcttactaattgtttttctcatttattgtttcagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataagaatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 423918 - DNA, 2523 bp, Homo sapiens
gtgaccagatattagtgttttttaatagaaagtgttgcaggtgatttcaaatatagagtgagatttgataacttgtgatgaaggactttttattgctatgtcttgattgtcaccatttgatatgctcccctatgtcagctgctctataaaggcttgccaaatgattgatggactggacatcccctattgtatttgcccatccctgaatcctgaatggcattaagatgggtctggttctagattgagtcatgttggtcttcattttcttagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataagaatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 423919 - DNA, 2755 bp, Homo sapiens
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggtgtgtgttccttacaggtaaaacaaggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagtagatgttgctactgctcactctgggtccatgctgcttttatgagctgtaacactcaccacgaaggtctgcagcttcactcctgaccccagtgagaccacgagcccactgggaggaacgaaaagctccagactcgctgccttaagagctgtaacactcaccgtgaaggtctgcagcttcactcctgagccagcgagaccacgaacccaccagaaggaagaaactccgaacacatctgaacatcagaagggacagactccagacgcgccaccttaagagctgtaacactcaccgcgagggtccgcggcttcaatcttgaagtcagtgagaccaagaacccaccaattccggacacagtttgtcagttcctcaagtgttaaagctagaattactctatgccccagcaattccacttctaggtgtatacccaagagaaatgaacacatgtccatacaaaactcgtgcatgaatgttcataacagcattatttgtaatagccaaaaagttgaaacaacctaaatatccatcaaatgcctatcaactaataaataaacaaaatgtgatgtatccatacaatggaatattatgcagccatacaaagatatgaaatacagatacatgccacagcatggataagccttaaaaacattctgctatatgaaagtggccagtcataaatgatcacatatgatatgcttccatttacatgaaatgttcagaacaggcaattttatagaggcaaaaagtagatgagtcattgcctagagctacagggtaggtgaggaatggagtgcagggttttctttagggatgatgaaatgctgcaaaatggattgtggtgatggctgcacaatgttgtgaatatactaaaaaacactgaatcatgaaaattaaatttcttaattatatatgtggattatatcttaataaagctgttacaaaaaat

SEQ ID NO: 423920 - DNA, 813 bp, Homo sapiens
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtaggttaagaagaatgtccactttggttctgagttctaaaaccagttctaatctggagtgtatcattcaattcctcttttgttcatcttctctgtttattatataaagaaacaattgaatatgttcttcctgaagtttagctgatgaattttatctttcctatgaattggtattatatattttatgagattaataaatcaaaacctgccactcac

SEQ ID NO: 423921 - DNA, 2396 bp, Homo sapiens
ctcaaggacccctgtgaggccaggcagaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 423922 - DNA, 4063 bp, Homo sapiens
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggtgtgtgttccttacaggtaaaacaaggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataagaatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 423923 - DNA, 2255 bp, Homo sapiens
ctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggtgtgtgttccttacaggtaaaacaaggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaaattctgagctccagcaatcctaccacctcagcctcctgagtagctgggactacaggcatgcacaaccatgcctagctaatcttttatttttgtaaagacagggtctgattatgttgcccaggctggtcttaaactcctggcctcaactgattctcccaccttgccatcctaaagtgctgggatttcaggcatgagctcctgcccctggccaatgttcaaatatttaaatataagtttatccacatttttttctattatttttgttcactataccttctcacatctccaccttctttctcgaaaattttgtctttctgcagtatacgcttg

SEQ ID NO: 423924 - DNA, 841 bp, Homo sapiens
tttcaccatgttggtcaggctggtctcgaactcctgacctcaggtgatcacccacctcagccttccgaagtgttgggattacaggtgtgagccaccatgcccggcctagttgagatcttctaaagagagagtgtatggattaaaagagggccagcaatagaactctggggtgtctcaacattcacagaagtagcagaggaaaaggagctagtaaaagattttgagaagttatcaccagtaaggtaggaagagaacctaaaatataaagtactttggaaaccagttgaagaaagtgtttctagaaggagacataatcaactatatcaggtacaacttgacaggtcaagtaagacattgacaaggataagaatataggattttggaacatggcagtcactaatgacttcaacagcaattttattgaaggtagtatattttgaaagtcaaatacctatttttcatactatgcatatgtatatgttttaactatgtcataatttgtgcatatctcctgaatcttcttgaagactaaagacaagtttagagtttagaggagctttaaaactttgtgagattttctttttctgccttgatattaattaagatgacctgtagaaatttcctaagttattcttgaatttccaagagtagaaactatatattaatacttcaacaaagtaatggcttcttactttctttcatgtacaagtttcccttagttccaccttaaattacgtcagctgaggcatctagcactgcatgctccctcagaatgtagttgttactctttctcccgagacctgatagtacttcccagtgaaatgcctttttaaaaaaaaaa

SEQ ID NO: 423925 - DNA, 792 bp, Homo sapiens
tgctgtcctgaggattccaggctaaagctcctacggaatgtccgcatgacaaccgacgtttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactaggtaaggaccagagcaaggtcaggcctctctcaggtcccacatgtgtctctttcagtgagggccttgatgctggcttcccagacctgtcccagctggcttgggatggttgtgacagccacaccaggaacaggagggattactgcccctgcccttgctagaagactatgggaaatgaggaggcagggctgcccagcctcattaggtt

SEQ ID NO: 423926 - DNA, 1550 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423927 - DNA, 1307 bp, Homo sapiens
gctaaccccctaactcccgttcctcctcggcgtttcttctccaagtccgaagtcagggtccaggactgctgcgatgcatcagccccgcctctcatcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423928 - DNA, 2497 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaaaaaaaaaaaaaaaaacaaaaaaaaaaaaaaaaaacaaaaaaaaaaaaaagggggggcgcgcgcgccaaaaagctcccccgggggggcgccccattccgcgccgctcccccccgatatctttgtggcaaaaccacgggggccccccaaaataggaggagccgcactattataaaagcccgcagaagaccgctgcgcgcgcgcgcattaaacaacagcgtagcaggcaggcggcgagaaacaacgcgtgcgatcacgctgagggagcctcttgggggagaagagagaacccctcaacctgcgcgggagggaggcgagaccaccatacatgcgggcgccacaccgtccctcccctcagccacgagagtatatataaagcccgccctcaaagaggcgagacacataactaacacaactactcctagcagactagttacaacgtggggctacaccacacgaacgacggaaaaaatcagcgccggccgcctgacaacaaattcgcgccccacgcgcagaatcgtttaatactgggagccacattttttaacaccccgggggacgccgatggcgaatgaaaaaacgcgggagaactagaccaacaacaccaacagcacaacctaacgcacgcgacacaagtcaaagaccgcaacgaagcgccgccgacgcgcgagacccgtgcagccaaaaacagacagcacacgatacacgagaccagagcgaagacagcactgcaccacacgacgaacaacaggcacacaacaagcaaccagaagacacccaaagaagacaccacaaaaacagagaccacggcccacaagcacaaaccacacacgaaaccacagcagcccacagagaaccgaggcaaccgacaccgcgcaacacaatcccaaaagacaaacaaaagcaggcacacagcaacaaacacacacaagccagagaccacaaaacac

SEQ ID NO: 423929 - DNA, 1845 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaatgggggagtctgtctgtctagctagatctcttcatgttaagaggcgtgccaaggtccagcttaacatctacttgacccagagggaagatggagccacagatgaaatacagatctttgttgagatccattatgagtacaaagtattttagcagaaattcaagatggaatctgatgctgcatcccccactcctggagctccagatgtgtgtgctctgttcagactctctttccttatcagaagccttaactgccctcagaagaataaaaatattcccttagccagctttggcaaaag

SEQ ID NO: 423930 - DNA, 1206 bp, Homo sapiens
  misc_feature (25)..(25): n is a, c, g, or t
  misc_feature (30)..(30): n is a, c, g, or t
aattcgcggccgcgtcgactacggntgcgngaagacgacagaagggggcatgacaaccgacgtttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423931 - DNA, 1640 bp, Homo sapiens
  misc_feature (1524)..(1524): n is a, c, g, or t
  misc_feature (1537)..(1537): n is a, c, g, or t
  misc_feature (1579)..(1579): n is a, c, g, or t
  misc_feature (1603)..(1603): n is a, c, g, or t
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctttgggaggctgaggcaggtggattgcttgagcctaggagggagggagggaaagaaaggaagaaagaaagngacgagagggggngagagagagagaaagaaagaaagaaaagaaataaaagggagnaagaggaaaaagggaaggaggganggagggaaagagaaagagaaaagagggagagagaaag

SEQ ID NO: 423932 - DNA, 2095 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatggtaagagtggcagtctgaattctttttttaatttttattttaaatagaggtggggtcttactttgttaccaaggctggtctcaaactcctgagctcaagcaattctcctgcttctgcctcccaagctcaagcaattctcctgcttctgcctcccaaagtgctggaattacaggcatgagtcactgtgcccggcctgaactctgaattcctgaatcgctaaagggctaggaataacttttcttttcttttcttttctttttttttttttttgagacagagtctcgctctgtcgcctggctggagtgcagtggcgtgatctcagctcactgcaacctccgcttcctgggttcaagcaattctcctccctcagtctcctgagtacctgggattacaggcacgcaccaccacgcccagctaattttttgtgtatttttagtagagacagggtttcaccgtgttagccaggatggtctcgatctctgacctcatgatccgcctgcctctgcctcctaaagtgctgggattacaggcgtgagccaccacgcctggccaggttctgttcttaacctgaaatgatactcaggagcacccctgaggcttctcttctgcttcctccccacacagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423933 - DNA, 1495 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatggtaagagtggcagtctgaattcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423934 - DNA, 2056 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatggtaagagtggcagtctgaattctttttttaatttttattttaaatagaggtggggtcttactttgttaccaaggctggtctcaaactcctgagctcaagcaattctcctgcttctgcctcccaagctcaagcaattctcctgcttctgcctcccaaagtgctggaattacaggcatgagtcactgtgcccggcctgaactctgaattcctgaatcgctaaagggctaggaataacttttcttttcttttcttttctttttttttttttttgagacagagtctcgctctgtcgcctggctggagtgcagtggcgtgatctcagctcactgcaacctccgcttcctgggttcaagcaattctcctccctcagtctcctgagtacctgggattacaggcacgcaccaccacgcccagctaattttttgtgtatttttagtagagacagggtttcaccgtgttagccaggatggtctcgatctctgacctcatgatccgcctgcctctgcctcctaaagtgctgggattacaggcgtgagccaccacgcctggccaggttctgttcttaacctgaaatgatactcaggagcacccctgaggcttctcttctgcttcctccccacacagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423935 - DNA, 1433 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtgttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423936 - DNA, 1512 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423937 - DNA, 880 bp, Homo sapiens
ttctcctgcctcagcctccggagtagctgggactacaggcgcccgccaccacgcccagctaattttttgtgtatttttagtagagacagggtttcaccgtgttagccaggatggtctcgatctctgacctcatgatccgcctgcctctgcctcctaaagtgctgggattacaggcgtgagccaccacgcctggccaggttctgttcttaacctgaaatgatactcaggagcacccctgaggcttctcttctgcttcctccccacacagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423938 - DNA, 1140 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactaggtaaggaccagagcaaggtcaggcctctctcaggtcccacatgtgtctctttcagtgagggccttgatgctggcttcccagacctgtcccagctggcttgggatggttgtgacagccacaccaggaacaggagggattactgcccctgcccttgctagaagactatgggaaatgaggaggcagggctgcccagcctcattaggtt

SEQ ID NO: 423939 - DNA, 1185 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgtttggaccgaattctaatttttcttgactacaagtcttcaaaataatgttttcatttttttcttcttttttccatttttttccaatttggagtcactgaaaactaagctgtgctttcataaagccctgcaaactgaatctagacaacttcagaagaaaaataacagcaacctatttacatacataagccactttcatacctgcctaccgatgtatggacttcagagtaatgtggcttatagcaattttccaggattgttcttttgtttgttgttgttctcccttcctccccctattttgtctttatgggacatgacacttcacaac

SEQ ID NO: 423940 - DNA, 1030 bp, Homo sapiens
  misc_feature (25)..(25): n is a, c, g, or t
  misc_feature (30)..(30): n is a, c, g, or t
aattcgcggccgcgtcgactacggntgcgngaagacgacagaagggggcatgacaaccgacgtttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagagtcaagaaaacttttaagctatttatagctttaacaattgagtatactcctatgaacaaaatttgcagcatatttgtttttctctgatttctccagaatttggagattattttttggaccgaattctaatttttcttgactacaagtcttcaaaataatgttttcatttttttcttcttttttccatttttttccaatttggagtcactgaaaactaagctgtgctttcataaagccctgcaaactgaatctagacaacttcagaagaaaaataacagcaacctatttacatacataagccactttcatacctgcctaccgatgtatggacttcagagtaatgtggcttatagcaattttccaggattgttcttttgtttgttgttgttctcccttcctccccctattttgtctttatgggacatgacacttcacaac

SEQ ID NO: 423941 - DNA, 598 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaagccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 423942 - DNA, 381 bp, Homo sapiens
ctccaaaagactcctgtcatccagcttgtgctcttcatgtgcgtgcagtaaggcactctggaaagctgaacccacgcaattcaaaggccctgacagtggtgatttagtgtcttaaagttattagtaggctgggtacggtggctcacacccataatcccaggactttgggaagccaaggcaggaggatcttttgaggctgggagtttgaggaccagcctaggcaacatagcaagaccctgtctctacctactaaaaatttttaaaattagctaggcatggtgccacacacctgtaatcgcagtgattcaggatgctgacgtggaaggattgcttaagcccaggagttcaaggctacagtgagccatgatcatgccactgcac

SEQ ID NO: 423943 - DNA, 1025 bp, Homo sapiens
gaaggacttcctcctctgtgtcactgaagtcataggggtgtatgaatccccatcttggcatctggctggcgagtcttccttctcttcctcttctgctcctggtcctcttggcttttctcctcttcatcttctgtctctgattcatcctcacttcgcttcttacgtttcttctccttctccagaaccttcttaaagtaagcatactggaccaactccacagcttccttcgatcctgcaggtccacagtcttgctcatgcgggccttcgcatgggctgtggccagtcgaatcagagtttccagtgttcgggctgtaactggagatggaatgcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggtttttcattcccgttgttatggagggccacatctgccagagcctggagtctgcgaaggccgggaccggttccccggcccacag

SEQ ID NO: 423944 - DNA, 524 bp, Homo sapiens
ggtcttgttgattgtggcagatttgtggggtggaaggagaataactgaggagggcttgaaggcaggagactgttctcccgaaagatcctgctccaccctgccagggcccgtgggtggggcctgggcctgccctgcgtgagctgccctgggccttggccgcatggatctggagggtggtggtgggagggtcagatgggggagggagggtcttggcagctgcccctgtggagggcacggtggggctcaggcctgactctctcctgccttctgccctgcagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423945 - DNA, 1006 bp, Homo sapiens
ggcgggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423946 - DNA, 1480 bp, Homo sapiens
gccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataacagtgaattaagcgtgttactgttttaaaaaaaaaaacggacgcgtgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctgtatcctgccgggggcggaccgggtcgaggggcgtgggggagggaggcagcgggtcgccctctcctgccccggagttctccttgacgctcctcagcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423947 - DNA, 1382 bp, Homo sapiens
gccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataacagtgaattaagcgtgttactgttttaaaaaaaaaaacggacgcgtgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggtggggccagggcctggcatacagtggggaaggccaaggccacagggcttgggggtggccaaggagtagggagcactccgggcagatggactgtaccttcccaaaggggccggaagccaggcagcggcggccggaagaacggtgggatgggaacgaaaagcaaggacaagaagctgtccgggacagactcggagcaggaggtgagtgaggccccagcccttcgccctgcccttggtgatgggacaggcagcctcgccaagctgacggaggagcagttaaccttctgaacggtgcccggaactgaacgggcagaggaagcggcgtccccagaggacgatactgaatacccggccggacagcccgggagacaccccaacacaaaaccacacgacaccacaaaacccaacaaccaccacaagaaccccc

SEQ ID NO: 423948 - DNA, 649 bp, Homo sapiens
gcctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaacaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaacgaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423949 - DNA, 1385 bp, Homo sapiens
gccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataacagtgaattaagcgtgttactgttttaaaaaaaaaaacggacgcgtgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423950 - DNA, 1268 bp, Homo sapiens
gccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataacagtgaattaagcgtgttactgttttaaaaaaaaaaacggacgcgtgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcag

SEQ ID NO: 423951 - DNA, 235 bp, Homo sapiens
ctgggtgccaaagagcaggcctctggcgtgatgcccagaggcacctgcgaagtggtgctgatgcacctggagcaagtgcccatctgccctttcccatccttacaagcttctctcccttcttcctggaattggattttatgttaaacaacttctaaggccagaacattcctctaggtgggttcatcttacttaccagaaattggcttatccccaaaaactttgaagtctgttgaca

SEQ ID NO: 423952 - DNA, 433 bp, Homo sapiens
ttgatggagtcttgctctgtcaccaggctggagtgcagtggcgtgatctcagctcactgcaacctctgactcctgggttcaggtgattctcctgcctcagcctcccgagtagctaggactacaggtgcctgccaccatgcctggctaatttttgtatatttagtaaagatggggttttaccatgttggccaggctggtctcgaactcctgacctcatgatctgcccgcctcagcctcccaaagtgctgggattacaggtgtgagccaccgtgcctggccaaatctatcttttgctgtacattttaaaacatatttctgatagttatgttgaatttcttgtttgctaattctaacatctgcccacctgttggtctgctgctctttgcagtttttttcccttgattatagtcagttattggttgttgtccttcac

SEQ ID NO: 423953 - DNA, 1294 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttttttttttttttttttttttttttttttttttttttttttttttattatactaaacaatataaaaagaaaccttaat

SEQ ID NO: 423954 - DNA, 1251 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagttttttttttcgcacacccaggcctcgctacctagcgtatagttt

SEQ ID NO: 423955 - DNA, 1280 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagttttttttttaaaattaaataaatttatttataatatataatatatataaaaaaaatttaattaactttttatt

SEQ ID NO: 423956 - DNA, 1105 bp, Homo sapiens
aatacttacgtaagagcaaagcctaaaaaaaccaggaaattaataattttcatcttcttagaccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttttttttttttttttttttttttttttttttttttttttttttttattatactaaacaatataaaaagaaaccttaat

SEQ ID NO: 423957 - DNA, 819 bp, Homo sapiens
aatacttacgtaagagcaaagcctaaaaaaaccaggaaattaataattttcatcttcttagaccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttttttttttttttttttttttttttttttttttttttttttttttattatactaaacaatataaaaagaaaccttaat

SEQ ID NO: 423958 - DNA, 1246 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttttttttttttttttttttttttttttttttttttttttttttttattatactaaacaatataaaaagaaaccttaat

SEQ ID NO: 423959 - DNA, 765 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgccttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttttttttttttttttttttttttttttttttttttttttttttttattatactaaacaatataaaaagaaaccttaat

SEQ ID NO: 423960 - DNA, 749 bp, Homo sapiens
gctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcaccgctttgtctctcccgcagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccg

SEQ ID NO: 423961 - DNA, 872 bp, Homo sapiens
gacagtgatagggtgaaatggattgaattattccactcatagaaaagtgaggtgagactgacacacagaagagagaaagaaaagagaggaccaggtacaggagaaatgcataaattgtaacagcaatttagagaggatcagatattttgagcatgctttcaactctttactttctatcctttacatactaacctttgtggatatgttgtatataattacagataaaggcatgttatatattaattatatcatcaatggactgttttattacttctttcaaccaattcttcaattttactcaagctgcaaatcacactatcaaaagttaaagatgaaaaacacttgcaaggtcacggcttgtcctttttcctgagtagggggaggaaaaccagtgttttcttcagtattttgtaaaagtgatattctatctttccacgcttgtgtgcactactgaggtctgcgcaaatgctcttgctttgctggttggttttgctcagagacaggttttaaatgcactagaggaaagcagcttttgctaaatgttttataacgtgtcaggaaacctttatcgaacatttaatccaaaacctggctttgaaccagggaggcatacaatttcgtaattaattttttaaccttcttttgctaatcgctgataaaaagcttaattctattaacaactcgacttgacaaattgcaccgctcaatggaagcgtttagaaattaattacgcattttattgcattagatcggataaacaaggaaggatcagcaaggaaaaggaaaacccaaaaagaaggaaaatggccaaatatatacaatccactggtgtctgactatttccattattattcaatgtgtcaccaaaaaaa

SEQ ID NO: 423962 - DNA, 1611 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423963 - DNA, 1447 bp, Homo sapiens
catagtaactggttgctcttcctattggtcatagataaatgacacctgcacaattctccgagtgctttaagcaacttcgggaggcgtgactaagaccctttccttgctcccagcttcctatgtcccagggctgcctgtggcacctggactgctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423964 - DNA, 923 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactgggtgtttgctctgcagaggcaggggtcagc

SEQ ID NO: 423965 - DNA, 2065 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagctgggcaccctagatgtacagctgcccactctcctggtcgagctgttgaggcagtgtgcaccgtgcctgcctctgtgctgggcgcggggactggagctggctccacccacagccctgtcagaggagcacggggcggtgggggggcggtgacaatttgagctgtctctcccagctcccaaaagggcaggtgagacgaccttttgagtgctgggtgaatgacagggccacaagtgtttagaggccgggcacggtggctcacgcctgtaatcctggcactttgggagaccgaggcaggcggatcacctgaactcaggagtttgaga

SEQ ID NO: 423966 - DNA, 1970 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagctgggcaccctagatgtacagctgcccactctcctggtcgagctgttgaggcagtgtgcaccgtgcctgcctctgtgctgggcgcggggactggagctggctccacccacagccctgtcagaggagcacggggcggtgggggggcggtgacaatttgagctgttgggccagggatggtggctcacgcctgtaatcccagcactttgggaggccgaggcaggtggatca

SEQ ID NO: 423967 - DNA, 913 bp, Homo sapiens
gactcctggcctcaagtgatcctcctgcctcagcctcccaaagtgttgggattacagaggggtggcgtggtgcctgtccctgccatccttttgaagccctacagctccacccaacagaggtcttatcagggcttctcattgagtaagctgacactgagcatcattgaatatcaggcctgctcaagcctgtggcttagagtctgtgtctagattgggcagggacaagattgagcatctggctgagcctacactcagcaggttgtgggccaggggtagccaggcctggctccctgtcccaccttgctccatatccacaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423968 - DNA, 1263 bp, Homo sapiens
gcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423969 - DNA, 1588 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423970 - DNA, 1342 bp, Homo sapiens
gcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccaggtacagccatgtgctccaccctagccccaacacgctgccccttggctactggctgctgagtggcacccccgccccgcagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423971 - DNA, 1212 bp, Homo sapiens
cgggccagtacgtgatgtggagagaggtggggcaggacagggcccgtcaagccccagaggtaaccaagactgagaaggagtcttgctctgttgcccaggctggagtgcaatggcactatctcggctcactgcaacctctgcctccgtggttcaagtgattctcctgcctcagcctcccgagtagctgggattacaggcacctgccaccacacccagctaatttttgtatttttattagagacggggtttcaccatgctggccaggctggtctcgaactcccagcctcaggcgatccacccgccttggcctcccaaagttctgggattacaggcttgagccaccaggcccagccgggccagtacggatgtgcatccggcacttcctccagaccttatgctggcgcagcaggaagggcagaagcatgaggtctggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423972 - DNA, 653 bp, Homo sapiens
gactcctggcctcaagtgatcctcctgcctcagcctcccaaagtgttgggattacaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423973 - DNA, 738 bp, Homo sapiens
gactcctggcctcaagtgatcctcctgcctcagcctcccaaagtgttgggattacagaggggtggcgtggtgcctgtccctgccatccttttgaagccctacagctccacccaacagaggtcttatcagggcttctcattgagtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgta

SEQ ID NO: 423974 - DNA, 1166 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagggagtggcaccagggcccagcactgacacagctaccacctactccccaccccctgtaccctgggagctggtctggagagagaaacacagtctggacaagagaaacgctcatcagacaccaccaataaacatcaaacagacaccatcttgtt

SEQ ID NO: 423975 - DNA, 1256 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggagtgcctttgcccagggatgtgcttcactgaggatggatctgccagagctagggccagaccccccgaggccccacctgctcttccctagggagtggcaccagggcccagcactgacacagctaccacctactccccaccccctgtaccctgggagctggtctggagagagaaacacagtctggacaagagaaacgctcatcagacaccaccaataaacatcaaacagacaccatcttgtt

SEQ ID NO: 423976 - DNA, 1341 bp, Homo sapiens
tgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgagaaggcctcgaacacttaggtccagcgatgggtgagaccaagctgatcctgggcctgccttcattgcggctcctgctcacagtggcctctaggggtgctatctaccactcctgggctggcatgcttgctgtcactggcccccagagcagtgaccctggcctgagcaattagggtggctccttccagagtctgtgtcagtgatggcaaaggggcagtgaacacagaaagtgaatcccactggtctggagagagaaacacagtctggacaagagaaacgctcatcagacaccaccaataaacatcaaacagacaccatcttgtt

SEQ ID NO: 423977 - DNA, 942 bp, Homo sapiens
cgggccagtacgtgatgtggagagaggtggggcaggacagggcccgtcaagccccagaggtaaccaagactgagaaggagtcttgctctgttgcccaggctggagtgcaatggcactatctcggctcactgcaacctctgcctccgtggttcaagtgattctcctgcctcagcctcccgagtagctgggattacaggcacctgccaccacacccagctaatttttgtatttttattagagacggggtttcaccatgctggccaggctggtctcgaactcccagcctcaggcgatccacccgccttggcctcccaaagttctgggattacaggcttgagccaccaggcccagccgggccagtacggatgtgcatccggcacttcctccagaccttatgctggcgcagcaggaagggcagaagcatgaggtctggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgagaaggcctcgaacacttaggtccagcgatgggtgagaccaagctgatcctgggcctgccttcattgcggctcctgctcacagtggcctctaggggtgctatctaccactcctgggctggcatgcttgctgtcactggcccccagagcagtgaccctggcctgagcaattagggtggctccttccagagtctgtgtcagtgatggcaaaggggcagtgaacacagaaagtgaatcccactggtctggagagagaaacacagtctggacaagagaaacgctcatcagacaccaccaataaacatcaaacagacaccatcttgtt

SEQ ID NO: 423978 - DNA, 786 bp, Homo sapiens
gcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagctgggcaccctagatgtacagctgcccactctcctggtcgagctgttgaggcagtgtgcaccgtgcctgcctctgtgctgggcgcggggactggagctggctccacccacagccctgtcagaggagcacggggcggtgggggggcggtgacaatttgagctgtctctcccagctcccaaaagggcaggtgagacgaccttttgagtgctgggtgaatgacagggccacaagtgtttagaggccgggcacggtggctcacgcctgtaatcctggcactttgggagaccgaggcaggcggatcacctgaactcaggagtttgaga

SEQ ID NO: 423979 - DNA, 349 bp, Homo sapiens
tgctcccagggtttgttcttgtagccccagagcctgcctgcccagcccttgcctgccttccacttgctcgcaggagtgcctttgcccagggatgtgcttcactgaggatggatctgccagagctagggccagaccccccgaggccccacctgctcttccctagggagtggcaccagggcccagcactgacacagctaccacctactccccaccccctgtaccctgggagctggtctggagagagaaacacagtctggacaagagaaacgctcatcagacaccaccaataaacatcaaacagacaccatcttgtttccccctttctggagcacaactctgtggcccccat

SEQ ID NO: 423980 - DNA, 939 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcagatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaa

SEQ ID NO: 423981 - DNA, 1638 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaa

SEQ ID NO: 423982 - DNA, 1471 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaa

SEQ ID NO: 423983 - DNA, 2004 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccggtgagccccgcacggccccgccccggcccgggccggccccgctttgtccggccggccggtccccccagccctcgggggcctcgctgggttcccgcctcctcccgtggcattaaagggcccgcagcgctcagggcgcggctgcgcttacccccctccccgccccgttgttgtgccctccacggcttcgcgcgggccggggtgggaggctgaatcccggccgcgaccccccgggagcgcagttttcgcccccggccgcgggagcccctccccgggcgcgcccgcgccccgtgagcacggcgtggagggggttaagcgcggcggcggccccggggggcttgacagcacattgcgcggcgacgtaaacaaagctgacccgccgcggacctcggcgcgggcggggacggcgccaccaccccgcgggcggggacggcgcccccaccccggccggcccgcgccccgcgccctctcccggccccctctcgggtctccgggccggccccgccctgaccggccgcgcgcgctgtcgcccgcagatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaa

SEQ ID NO: 423984 - DNA, 1880 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaa

SEQ ID NO: 423985 - DNA, 2363 bp, Homo sapiens
ggtgttgttgaaactgaaaatactacattatgctaatcgcggccgggcccgcgcgcacgggggtggggcccgcgcgtataaagggggcgcaggcgggctgggcgttccagcaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaaaaaaaaaaaaaggggggggggccgatcaaaaagtattctccccgggagaggggcgcccacacattataatcgtatctacccaggatttcatgtcagaaaaagggtggtgccccaaatattataggtcgcgctcattttataacacctctatagacacgtggcagcattagttaaacacaactgtcaagactgtggagaaacacctcggttcacacctggggcggactctcctgtgtagcgaacagaacaccctataaatctggggcggggcgagccccacattctaggtgggcccacaacacccacaccacacacgatagtatctactacgaccccccctgagcggcggtacatcattagtaccacgtttgccaacgtgctgctctcacagtgttgacaagcacacaaacactcggtgtagaaatatattagcaggaacgtcgatcgtactagaaagaaaagtacttgcgctgtcctacacagtgtaagtgaattactctactaccttctaaacgaaacatctcattttaacaaccccgcgagggtcactcactttctttcaaatcaagccacgcacgccaaaataccagtaccgatatcgaacgctatacacagcggcgtgtaacgcagggaagaatataaagcaaacgactacactatttggcatcgtagatcatgcgtcacgagggacacttgaaagccacgtaatcttagcagctgtagctgagtcaagacaggacagcgcgtagtggtaggcgagtcagataggacatagagagagacacgtaacagcgagaaaactccaaacgacaaaatcacgcacgaccccaatgaacctgacatatgaatacgagagcgataccg

SEQ ID NO: 423986 - DNA, 421 bp, Homo sapiens
gtctgttatgtgctagaaacacccagaagctaattctggcactactgtgaattcagattttgaaaattgggaaatgtatcccaataatgcattttttcagaagcttgccaagctgatttagatgaattccattgtcatcagtagtggtgagtttgaccattaggggcctatatctggttttagttgtcttaaaacttaatgacatcatgcaatatttttaaagttactctatttctctttgagtttgtactctttagtggaggggaaaaagctgcatatttcatacgtataccagtataggcttcatatatgtgagcacagcaatgaagtctttactaatttatttgggcatggcatatataaattaaaagtttttgaaaaaatggtatttgagaatttaataaaatggcccaataaaggg

SEQ ID NO: 423987 - DNA, 491 bp, Homo sapiens
ttctgaattcatggtttctctgcatgacccgtaaagtctttagtctatgtccagggaatcacagttcaatgtacaatattttttgattcctccaaatttatttggacatgttttactatctcccaggggctcaaccctggtaaagagaatgaagccaagatccagtggtgtgctagcgccagtttatataagctcataaaattttattgttagaatcttcccacccactaccactgctgttatcactgccagagagctgtagcatgagctccacagagcctgagagccacctacctagactggctgccactggcagaaaccccaccccgcctccagcagcaaggttgccacacacttgcatacatgctgaggatagcctgctgctgctggggcatgccaaccagggcctgggaattgccccactttgcccaccacagcctattcctatgcatgccactgggggcctcaggacaggcacacctggcctggca

SEQ ID NO: 423988 - DNA, 444 bp, Homo sapiens
ctctcgtgagctcttactcactatcatgagactagcatgggggaaaacatccccatgattcaattacctcccatctgctccctcccatgatatgtggggattatgggaactacaattcaagatgagatttgggtggggacacagccaaactatatcaaccatactttctccactacactcatgcatcacatttatcttaggtgactggataatttgtggtctgtttctagactttcttttttccaatagtctatttgtctctcctgagctaatatcgtactaaattaatacctataactttatattatgtcttgatgtgtggtaatataagttatctagctttatttttcaagattatcttggctattcttggccttttacaaactaaattttagaatcaacttgtcaatttctgttaaaatatttttctgggatttttattaa

SEQ ID NO: 423989 - DNA, 1657 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 423990 - DNA, 1845 bp, Homo sapiens
cgggatttagatcacgtcccgcaggccggcggaagtagctgatactctcattggttgcaaaaccttgatctgtgaaagcgggcgttttggaagataccggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaaaaaaaaaaaatattctttttgcttgttttacctcttgtcttgctgtacacgcacatatcttcttttgttttaaaatatatctctatatacgcagcactccactctaacctattattttaatagaaactaaaacaaacgtag

SEQ ID NO: 423991 - DNA, 1301 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaaagggaggaagaaggagacttcagagaaagaggccgtgtgatggaagcaaaatcagagagaaaagatgctaagctgctgcctttgaataaggaggaacgtgagccaacagatccaagaactgaagctctaggcagtggaaaagccaaggaaactgatcttcccttcgagcctccggagggagtgtagccctgccaacacctttattttagccccataacagtcatttcagacttgtggcctccagaattttaagagaataaatttttattgtattaagcca

SEQ ID NO: 423992 - DNA, 942 bp, Homo sapiens
ctagtacaacaattcggtgaaggatgaggctggcttagaccagagtgatggagaggcgatgagcaaggagcagattctaggtgtgcttagaggcagcaggatttgctgatgaaggggttatgactgagcaaataagactgagaaggagcagccaggagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 423993 - DNA, 839 bp, Homo sapiens
gctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctctgtcgtgtgtggagtgccatccccaagggtgtctgaacttctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 423994 - DNA, 694 bp, Homo sapiens
  misc_feature (39)..(40): n is a, c, g, or t
  misc_feature (54)..(54): n is a, c, g, or t
gggcgtcccgaccctggacagagggtttggttttttttnngccaaacggggttngagattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 423995 - DNA, 569 bp, Homo sapiens
aaagtattttgatggaagaatagtacctgataagaaactgatttaatattaattataataagtactaaattcagattaaaattagggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaaatggagtcttgctctgtcaccaggcaatcattaatgatattggttgtaattttagagttataaaaaaaataagaaaatggggagaaagaaaagggggaaacaggaagaagataaaggagagaacagaaaaagaaggaaagaagaaaggcaggaaagcaggaaggaagcagcaagggaggaagagaaggaggaagacagacaatcacaaagcagacttttcaggtaactg

SEQ ID NO: 423996 - DNA, 1674 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaacattgaagattttgtgt

SEQ ID NO: 423997 - DNA, 1947 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaaaaaaaaaaaaaaaaaaaaaaaaaaaaattgtgttggggcggcttgggccctggaaaaagttttttaaaccattggttgggggcggggggccccgttaggtaccgtgacctggggccaaacgcggtccccaaggagaaacccgggcacaggaccaagggtccgggatttcctcccccatataaagaaacgcccgggggggcacacagagggtttctgaacaatcccgagggagctcggaaggccacacgggctcctacacacagggagtccaagagagtcgaaataatacg

SEQ ID NO: 423998 - DNA, 1450 bp, Homo sapiens
tagtgagtccagtgcgtagctcgtatactcaatttacgccccgcaccgtgactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 423999 - DNA, 1477 bp, Homo sapiens
tcaccgcttgtccctctgactgcagccaggaacgtttctctaattttaagtatttatgtgaatacattgggctcacccagaaaataatgaagaataatctctcatctcaaagattataaccttaatctcatttataaagtcccactttactgtggaaggtaacatcccaagtttcaataattagcttgtagacatctttgggggaacatcattctgtctaccacattcaggaatattttgacctattcaagcatagaaagaagttcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaa

SEQ ID NO: 424000 - DNA, 1153 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagagggaggaagaaggagacttcagagaaagaggccgtgtgatggaagcaaaatcagagagaaaagatgctaagctgctgcctttgaataaggaggaacgtgagccaacagatccaagaactgaagctctaggcagtggaaaagccaaggaaactgatcttcccttcgagcctccggagggagtgtagccctgccaacacctttattttagccccataacagtcatttcagacttgtggcctccagaattttaagagaataaatttttattgtattaagcca

SEQ ID NO: 424001 - DNA, 599 bp, Homo sapiens
cgggatttagatcacgtcccgcaggccggcggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattggaaatttggaagattttcaaagggcaatttggaaatatgtgagaggtatagaaatttttggactttgt

SEQ ID NO: 424002 - DNA, 487 bp, Homo sapiens
  misc_feature (464)..(464): n is a, c, g, or t
  misc_feature (468)..(468): n is a, c, g, or t
  misc_feature (471)..(471): n is a, c, g, or t
  misc_feature (475)..(475): n is a, c, g, or t
  misc_feature (479)..(479): n is a, c, g, or t
ccgctcccccccactctcctctttccgataaagtcaccttccacccttactacacaagtcaaagacgcccactctcctctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatcaaaaaaaaaaaaaaaaacaaacaaaaaaaaaccttgttgggnccgnccngggncccnggaaaaag

SEQ ID NO: 424003 - DNA, 429 bp, Homo sapiens
  misc_feature (406)..(406): n is a, c, g, or t
  misc_feature (410)..(410): n is a, c, g, or t
  misc_feature (413)..(413): n is a, c, g, or t
  misc_feature (417)..(417): n is a, c, g, or t
  misc_feature (421)..(421): n is a, c, g, or t
caattttgctttccggtggagtttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatcaaaaaaaaaaaaaaaaacaaacaaaaaaaaaccttgttgggnccgnccngggncccnggaaaaag

SEQ ID NO: 424004 - DNA, 229 bp, Homo sapiens
  misc_feature (165)..(165): n is a, c, g, or t
  misc_feature (173)..(173): n is a, c, g, or t
  misc_feature (209)..(209): n is a, c, g, or t
  misc_feature (218)..(218): n is a, c, g, or t
ttgaggatccccgctattcatcggcacctcgtattcatcgtttccggcggtgacgacctacgcacacgagaacatgcctctcgcaaaggatctccttcatccctctccagaagaggagaagaggaaacacaagaagaaacgcctggtgcagagccccaattcctnaccttcantggggcacttggtttgaacaacaatttgggcccccnaaagcgaantgggctttaat

SEQ ID NO: 424005 - DNA, 448 bp, Homo sapiens
  misc_feature (425)..(425): n is a, c, g, or t
  misc_feature (429)..(429): n is a, c, g, or t
  misc_feature (432)..(432): n is a, c, g, or t
  misc_feature (436)..(436): n is a, c, g, or t
  misc_feature (440)..(440): n is a, c, g, or t
ttgaggatccccgctattcatcggcacctcgtattcatcgtttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatcaaaaaaaaaaaaaaaaacaaacaaaaaaaaaccttgttgggnccgnccngggncccnggaaaaag

SEQ ID NO: 424006 - DNA, 781 bp, Homo sapiens
gcaccagtaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaa

SEQ ID NO: 424007 - DNA, 735 bp, Homo sapiens
gcaccagtaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaattattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaa

SEQ ID NO: 424008 - DNA, 432 bp, Homo sapiens
gcaccagtaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatatccctcatgaataaattaatgccctctctggattgaggggtgagtgagctatcgctctgttaatttttgtgatgtctgcatacactggctctcccttcatcatctgccatgagtggaagcagcctgagacccttagcagaagcagatgctgcaccatgattcttgtacattctgcagaacagtgagccaaataaacctctttattaatcacccag

SEQ ID NO: 424009 - DNA, 727 bp, Homo sapiens
tctgtatttgttccatcttgcttttacagatcaatacaaataggtaactataccttctaaacaaacatcaagttggtggaaaaaaggcatatgaacagttctttctcacctactatcaacaaacagtaaattaaacattcctaactgcagcctccttttgtaaaatttataaccatttatcttttgagtgtgacatgatactagatgtatgataattacatgttttgtgtatcagtatgaacatgatttttaacagacttgttccaatgaactattatagagatggtccccaacaatgtcaactaacaatttctcagctttatgatggtacaaaagtgatatgttgctatagtttggatatttgtccctccaaatctcatgttgaagtttgatctcagtgttggaggtggggcctaatggaaggtgtttgggtcatggtggaagatccctcatgaataaattaatgccctctctggattgaggggtgagtgagctatcgctctgttaatttttgtgagagctggttgttcaaaagaacctggcacctcctccctcaccctcttgttttctctcttgccatgtgatgtctgcatacactggctctcccttcatcatctgccatgagtggaagcagcctgagacccttagcagaagcagatgctgcaccatgattcttgtacattctgcagaacagtgagccaaataaacctctttattaatcacccag

SEQ ID NO: 424010 - DNA, 1031 bp, Homo sapiens
agtacccggtgcgaggctgggtggcgaaacaagttgaaggagccggctttacttcgcaagctgggccggaaggtggtggtcgtacgctgtgaaggcatcaacatttctggcaatttctacagaaacaagtcacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424011 - DNA, 587 bp, Homo sapiens
cttttccaagcggctgcgaagatggcggaggtgcaggtcctggtgcttgatggtcgaggccatctcctgggccgcctggcggccatcgtggctaaacaggtactgtgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 424012 - DNA, 736 bp, Homo sapiens
gaaacagctcatgaggctacggatcttggctttctctttcctcttctcctccaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424013 - DNA, 156 bp, Homo sapiens
ctgctcgaattcaagcttctaacgatgtacggggaacagctcatgaggctacggaaacaggccgagaagaacgtggagaagaaaattgacaaatacacagaggtcctcaagacccacggactcctggtctgagcccaataaagactgttaattcct

SEQ ID NO: 424014 - DNA, 1135 bp, Homo sapiens
cttttccaagcggctgcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424015 - DNA, 882 bp, Homo sapiens
ttccgcacccaggcgcacttctgcacccaggcgcacttctgcaccagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424016 - DNA, 883 bp, Homo sapiens
tattggtcatagataaatgacacccgcaccattctccgagtgctttcaagcaacttcgggaggcagtgactaagaccctttccttgctcccagcttcctatgtcccagggcgcctgtggcacctggactgctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424017 - DNA, 657 bp, Homo sapiens
cttttccaagcggctgcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 424018 - DNA, 1318 bp, Homo sapiens
cttttccaagcggctgcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttcctaaaaaaaaaaaaaaaaaaaaaaaaaagaaaaaggaaaaaaaacaagaaaaaaaaaaaaaaaaaaaacgaaaaaaaaacaaaaaaaaaaaaaaaaaaaaaaaaaaaagggggcgggcgcgcggcgcaaccagtttcctccggggggagagacacgaagataagatgacacaggacgaagcgttttgttaattgtagaaaaagagagaggggggcactaatatagagagagaggggagtgagtatgtatattataaataaaaaggaaagagagcgtgaggtagggggattgatgttaaatataaagaagagagaagtggaagagagagaggaaaaaaaaatgagtagtaagaataggatggtagttatatattgattgtaagaagacgacgcgcaactctcaatactgcacgagcgagggggacgggagcagagagaacagaaacgagggaggaggagggagcgaagcagaagaagaacgaacacccataacgagcaaaccgaatacagataaaagaacacacaaacacagcaataagagcgagggagcaaacatcaaatgcaatgaacacagagcgcaagcgagaggggggcgacagacagagacgagagagaagagaaaacaacaaacgaaccaacagcaacgagaagagaagcaac

SEQ ID NO: 424019 - DNA, 1081 bp, Homo sapiens
cttttccaagcggctgcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagcaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaacaaaaaaa

SEQ ID NO: 424020 - DNA, 1753 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424021 - DNA, 410 bp, Homo sapiens
ggctgtgtagacttgactatcactaatctgcttgagggggccgtagctttcatgcctgaagacatcaccaagggaactcagtccctacccacagcctctgcctccaagtttcccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtggagccgcaggacggagactgggggcagccctcacccaactcacaacaggctggatgggtgggtggtaaaaagggaaggatgaggctcccccaatgtcacattaaattcatggttttcattcaa

SEQ ID NO: 424022 - DNA, 1888 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccgcatggaggatactgagccttacccctaaccccgatcctctacccaacatgtcagtttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424023 - DNA, 2174 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaacaaaaaacaaaaaacagacaaacgagaaaaaacataaaaagggtgggcacactaagacagtcgcccataaagcagcactactctccgaccaccgagaataaagaaaaacagaggaagcccaaaccaacagcgcgtacactagacgacggggcgagtgaacagacccccaccgaaacacatacactacacaccctatcaaaaactactacctcgacacggtaaatatcagaacacacacctccacataaccaacctaaagcgcaacacaaccacacaaccctaactcgccaacacaccatactcaccgcctcaaacccactacaacattaaataacatcaaacagcaagccaaaataaacagactaactagaacgaaatatacagaacaaagaaacaaaactaaacaacaataactaagcacactaaacatccacacaaaacaaaccaaccactcacctgataactcatctacactccaccaa

SEQ ID NO: 424024 - DNA, 1792 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424025 - DNA, 1798 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424026 - DNA, 1880 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424027 - DNA, 1932 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424028 - DNA, 1631 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424029 - DNA, 2149 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccgcatggaggatactgagccttacccctaaccccgatcctctacccaacatgtcagtttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424030 - DNA, 2033 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424031 - DNA, 1987 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaagggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424032 - DNA, 1506 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424033 - DNA, 1342 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagagccgcaggacggagactgggggcagccctcacccaactcacaacaggctggatgggtgggtggtaaaaagggaaggatgaggctcccccaatgtcacattaaattcatggttttcattcaa

SEQ ID NO: 424034 - DNA, 695 bp, Homo sapiens
ctctagagtatcccacgcttgtcgctttcgagttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424035 - DNA, 1745 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagttgtggctcggggaccccttagccaacagccttaacatttcgcgtcttcttggcccggcatgtcttccaggcgtctgctggcttttttc

SEQ ID NO: 424036 - DNA, 583 bp, Homo sapiens
tgtctagggagggagggaaagaagcactgggctgactgggggcgcaatctggggtgtctttgtcgcttcatgtgctctgcttgtcatccagagagacctggccaagactggctgtgtagacttgactatcactaatctgcttgagggggccgtagctttcatgcctgaagacatcaccaagggaactcagtccctacccacagcctctgcctccaaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424037 - DNA, 370 bp, Homo sapiens
ccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattca

SEQ ID NO: 424038 - DNA, 346 bp, Homo sapiens
aggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccaca

SEQ ID NO: 424039 - DNA, 1691 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424040 - DNA, 2158 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaaaaaaaacacccaataccacaacaccacaaaaggggcgcggggccataaagaagatcaccccctcgggggcggcccccgacttaaagcgggcgccccagctttgtgcccaacgagggggccccaagaggaagaccgcaataatcagatatagctaacgtagccgatgtgttaataaccacgcgtgctgcgcacgggtggacacacttgcgtcactcgacgggcgaccccctgggcgacaagcgagcaccccattactcttgtggggtggggggacaatcaggtgcgggccaccctataaccccctacgcagatactatttaagccgcgtccgtaaccgcataattataaacagctacgctggctgatactaaggtggtgccacctcaagctgtaatatgcctactctgtccgtcattacagctattctgcatcacggacgacgactatatgcaaactactcatcagg

SEQ ID NO: 424041 - DNA, 1540 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424042 - DNA, 1624 bp, Homo sapiens
  misc_feature (1536)..(1536): n is a, c, g, or t
  misc_feature (1539)..(1539): n is a, c, g, or t
  misc_feature (1546)..(1546): n is a, c, g, or t
  misc_feature (1557)..(1557): n is a, c, g, or t
  misc_feature (1560)..(1560): n is a, c, g, or t
  misc_feature (1562)..(1562): n is a, c, g, or t
  misc_feature (1566)..(1566): n is a, c, g, or t
  misc_feature (1574)..(1575): n is a, c, g, or t
  misc_feature (1586)..(1586): n is a, c, g, or t
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaagggatccagagagacagcccagagtgatgantcnaggacgntgcccagacgngangnaatnggggctcnnatcacaagtgntgggggggaagggggtgggtcccgtcttattttggttc

SEQ ID NO: 424043 - DNA, 1784 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424044 - DNA, 1482 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagcctcacccaactcacaacaggctggatgggtgggtggtaaaaagggaaggatgaggctcccccaatgtcacattaaattcatggttttcattcaa

SEQ ID NO: 424045 - DNA, 1952 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424046 - DNA, 1637 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424047 - DNA, 2193 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424048 - DNA, 1070 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424049 - DNA, 2222 bp, Homo sapiens
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaa

SEQ ID NO: 424050 - DNA, 3618 bp, Homo sapiens
  misc_feature (1907)..(1907): n is a, c, g, or t
  misc_feature (2034)..(2034): n is a, c, g, or t
  misc_feature (3054)..(3054): n is a, c, g, or t
tggcaaacatctacactctctttctttcaccccatcttgtgatgtttttgttatgtacagtggaagagattaatgatatccatcaaatgaaatgatgatagtatacctatatcttgaaaatccatacacatatcagtgtatattttgtgtacaagatatgagtacaaggtaatgaaactaggtattctaagacatacatatatacacatacacacaagcatatgtgcaaatgagtgtgggccttttcaaagtagtcactttacgaggtcataatgtttattcctgttacatggctattgttcatattggttttagaactttgataacttcagcatattcatgtctaagcaacaaaatatttagtttttgtatgtggctttgggttttggtaatatccataggctattcaaaccttagtctacaaataatttacatgatgaacaagctgaggggtataattttaaatccaagataaggtgcatactaataaaatgaaataggtattctgttaattgaaataattctaaaacaattacaaaaggagaattcagaaatgtttgagcagtgtcagtgtctttgaaataagcgcagaacttctcaagatctagaaaggcagtttcatatgcaggaaggaacactggattaagttgcaaatcttagggtcagttcctaggcttccacttattaactgtttgggagctacttcagtgggactctgggttttaatctttgaagtgggttgatgctctcttagatccattagcgttaaagtccctgatgttgcgattctgctttgaaagtaattacaaatacatgtaaatgatgtcaggactgaggattggccacattataaaattgcaaagttttgccactattttctttaaataggtttttgtatgtttgttaaattttatctttttggccaggttcaatggcttagccctgtaatcccagcactttgggaggccaagccaggcagatcacttgaggtcaggagctcaagaccagcctggccaacatggtgaaaccccatctctactaaaaatacaaaaattagctgggcatgatggtgtgcgcctgtaatcccagctaccttgggaggctgagacaagagaatcacttgaacccaggaggcagaggttgcagtgagccgagatcacgccactgcactccagtctgggtgacagagcaagactctggctcaaaaaacagtttatatctttttgctttatatcaagcctattcctggttggatcattttgtttttacaggtgaggattcaaggatcaaaattaagtgactggctcagaaacagagcagtttacaaatcaagttagattggaagctttcagacttagacctacagttctgacttcacaaccttgaaatggccatttttcccactagtgggtagaaaatggatgaaaaaactttaacaaatggatgaaaataatggcgcagttttcaatttcataataatgtccattccccacttcctactaccctccatttatacttgtaactgaaaattttgtgggttagtaacaattagatgttcccattttacaagactaaaagcaaagagtttttacatctctgtctagaagaaactgtcacacacacgtaaatgtgaataatgcccatatagctgagaatattactaagggaaaccacataaggataatgttttgttattaaaattaaaatattttatcaggggtgcaacatcgtccattgaaaatgtccattctaaatacagctcttaatgtaattacagcaataatttagtttgtacattcaaggttgtgaacttttttatatttgctggatgcagttctgaaatttagtacttgtctgtcttaaggagatctgccctgcatgcaaatctataactagacaaatattanttcctttcccagcttgctcttgggaggtttccatatcctcaggtaagattgttcattactgctgtttgccactgtgacattcattcctatgtatgaaggtgcagggagcaattgtgaacatttgagncacatacaaataaatctgtcctgttaaattgaaaagtggtatcttaaagggttcatttagaaatctctattgatttttgatttttttaaactcctgattttttcttcttgttaaaggttgagagtgatcattgtgcttttcctttgtgtgacattcgggattgttttttttcctggtccaataccatgtactcattttgaggttggaggagagagccagctttttcttgatacactttttaagctcttaaattcacttaaaattttttgagttaaaagattaagacaaagggtgaaagcatctaatctaggtcattatttttgctaggcaaatatataggcccccaattttatgagtgtaattttgaacatattatttaaaaatattttgctccctcctgtctacatttgtaaggaaacaaaacagtccattatagtagcattgctgactctaatctttattaaaatttctttaagatttttattatagaagggtaccagcactaaaatagaaagctattttgtggtttgaaaatgattccccagtttgtgggggaaataagtgaaatgtctagagggatgaaaaatgaatggtttgactgttttcctctggttgatgttcactgtttttctggcatcttggtctgtacaggccaaagtgcctagaggcatgtctgatttaaaggtggtgttggtctctgctctttaagcatctattaacttgctattattatgcaaataagtgttgtattacacatactaatttatgcatggttagattatgcagatgcatcacaaacatggttattgaataataggatggggctcattctctctaccatctttataagcagttttaagcaaattctcctggtaccaatgtggacatttaaagaccctttactcaatgaaatgtctctttcgtattcttttgctttcatagttaaagccatcagataagtggaagagaaatcgtccaagttgttaggttcaagagtgttagtctcacttttcaaattcntagacttttttgtttaaatgtaatcttttccttatagagaaaatctaaaatgcagttgcttggcatgaatgctggcatttagtgagattttagtgtatatagccttgctgcttagctctaggtaacccatcaaattaaaattacattttcaggatttatagctcattagaatatttatcttggtaagcttcttattctgtcagtaatttctaaacaattcagcttggccaatttgtgaaatcccctaaaattttgaaagtgaactcacaagccctatgcagtatatttctcaaacaaatcttagtagaaaacttataagccatccagtaaaaattccaaaggttgagaatgtagcaatattcttgagattcctaatgtctagagtagttaatcagtgagatttgatgggtgatgagtctaagaaatggattttgccatggccaggtgcagtggcttacgcctgtaatcccagcactttgggaggccgaggtgggcggatcacgaggtcaggagattgagaccatcctggctaacatggtgaaaccccgtctctactaaaaatac

SEQ ID NO: 424051 - DNA, 2339 bp, Homo sapiens
  misc_feature (36)..(36): n is a, c, g, or t
cacgggccccttggggtaccccgccttccggtttancgggatgccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424052 - DNA, 2435 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacatgaaaactggacagaaggacccagaggtgttctttcattttctctcttacctccaatctttcccctttcaagctacaggtaaaggctctaccaccat

SEQ ID NO: 424053 - DNA, 2557 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaagactccaagttcttcagcttttggactcttggacctacaccagtgatttgccgggggctttcaggccttcagctacagactgaaggctgcactgttggcttccctacttttgaggttttcagacttggactggcttccttgctcctcagcttgcacgatggcctattgtgggacttcaccttgtcatcctgtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424054 - DNA, 1659 bp, Homo sapiens
gtggcagagctcctggagagaaatgaggtttgcaggccattggagttggactggacatgatggagggtcactttccccagagcgatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424055 - DNA, 2013 bp, Homo sapiens
catggcagactcctgtgatctgttctccaggtttacttcatctcttcatcaagaaaaggcaagaaccaagagacacgtcagcatctctggcttggaaccttaaactttaaagtcacgtggaacctggaagaatcccctcatctaattcagactcatttcgaatgaagaggcatgaaccccacagggggaaaataccttgctaaagccacccagctaatttttggcagaacctgacacagatgccagaagcaggttgtagtcaccgagtcagccataactgagtgtctcggacctgaagtcagcagttgagggctccagtcactgtgcatcaaatagctgggagaccctgggcaagtcagtcggtctctctgggccttgtcttttgtctgaatcatcagggactggctgaactatggaggctgacctgaccctcaaaggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424056 - DNA, 599 bp, Homo sapiens
cggccgcgaccgcggcagctcagcctcccgccgattgtatgttccaggcctcaatgaggagtccaaacatggagccattcaagcagcagaaggtggaggacttttatgacatcggagaggagctggggagggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424057 - DNA, 2047 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaagcaacctctggtacacgagctcgattcactgcc

SEQ ID NO: 424058 - DNA, 3589 bp, Homo sapiens
  misc_feature (2005)..(2005): n is a, c, g, or t
  misc_feature (3025)..(3025): n is a, c, g, or t
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaagactccaagttcttcagcttttggactcttggacctacaccagtgatttgccgggggctttcaggccttcagctacagactgaaggctgcactgttggcttccctacttttgaggttttcagacttggactggcttccttgctcctcagcttgcacgatggcctattgtgggacttcaccttgtcatcctgtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcaggtaagattgttcattactgctgtttgccactgtgacattcattcctatgtatgaaggtgcagggagcaattgtgaacatttgagncacatacaaataaatctgtcctgttaaattgaaaagtggtatcttaaagggttcatttagaaatctctattgatttttgatttttttaaactcctgattttttcttcttgttaaaggttgagagtgatcattgtgcttttcctttgtgtgacattcgggattgttttttttcctggtccaataccatgtactcattttgaggttggaggagagagccagctttttcttgatacactttttaagctcttaaattcacttaaaattttttgagttaaaagattaagacaaagggtgaaagcatctaatctaggtcattatttttgctaggcaaatatataggcccccaattttatgagtgtaattttgaacatattatttaaaaatattttgctccctcctgtctacatttgtaaggaaacaaaacagtccattatagtagcattgctgactctaatctttattaaaatttctttaagatttttattatagaagggtaccagcactaaaatagaaagctattttgtggtttgaaaatgattccccagtttgtgggggaaataagtgaaatgtctagagggatgaaaaatgaatggtttgactgttttcctctggttgatgttcactgtttttctggcatcttggtctgtacaggccaaagtgcctagaggcatgtctgatttaaaggtggtgttggtctctgctctttaagcatctattaacttgctattattatgcaaataagtgttgtattacacatactaatttatgcatggttagattatgcagatgcatcacaaacatggttattgaataataggatggggctcattctctctaccatctttataagcagttttaagcaaattctcctggtaccaatgtggacatttaaagaccctttactcaatgaaatgtctctttcgtattcttttgctttcatagttaaagccatcagataagtggaagagaaatcgtccaagttgttaggttcaagagtgttagtctcacttttcaaattcntagacttttttgtttaaatgtaatcttttccttatagagaaaatctaaaatgcagttgcttggcatgaatgctggcatttagtgagattttagtgtatatagccttgctgcttagctctaggtaacccatcaaattaaaattacattttcaggatttatagctcattagaatatttatcttggtaagcttcttattctgtcagtaatttctaaacaattcagcttggccaatttgtgaaatcccctaaaattttgaaagtgaactcacaagccctatgcagtatatttctcaaacaaatcttagtagaaaacttataagccatccagtaaaaattccaaaggttgagaatgtagcaatattcttgagattcctaatgtctagagtagttaatcagtgagatttgatgggtgatgagtctaagaaatggattttgccatggccaggtgcagtggcttacgcctgtaatcccagcactttgggaggccgaggtgggcggatcacgaggtcaggagattgagaccatcctggctaacatggtgaaaccccgtctctactaaaaatac

SEQ ID NO: 424059 - DNA, 1793 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagcaaacaaagacctgtgcacctgaaaaggggtaagagagtgaccacagtgaccacaaaagcacctgcagaaactatggattatcaatttatttattagtaattagtcatggtaatgagaaatcaagttgtgttttgaggttgattttttaaaacagctttattgatatataatttgcatgccataaaattcatctactcaattcagtgatttttagtaagtttataaagttgtgcaaccataaccataatccagttttagaacattttcatcaccccaaaaaagtgtcct

SEQ ID NO: 424060 - DNA, 1297 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaagtgaagtgtgtgccactccagcaaataaacgaagtcatccatgacaaaaaaaaaaa

SEQ ID NO: 424061 - DNA, 1026 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424062 - DNA, 250 bp, Homo sapiens
tgttcccttttacataatttttagttgatttatatgaatgatgattgtaggttaaatgaggaataattgcccattttatttccacattatctttatattgttctaacagactgttttgtctcatagctggtgaattctatagccaagacgtatgttggaacaaatgcttatatggcggtaagtaaacttatgcaaaaataatgtttaaaaccaacatctttatctttatgtacttggtaatgtataattc

SEQ ID NO: 424063 - DNA, 408 bp, Homo sapiens
caaaaaaaaaaaaaaaaaaaaagctaggcatgatggtgcacacctgtggtcccagctactcaggcagctgaggtggaaggattgcttgagcccaggaggtcaaggctacagtgagcagtgattgtaccccacagcacttcagcctaggtgacagggtgacaccctgtctcaaaaaaaaaaaaatgttgaatgtatttaaatatggaaagttccttttaaaaaccataattgataattgtactgttttctttttcctaaatttaggttgttaaaggccttacttatttgtggagtttaaagattttacatagaggtatgtgctgggcttataagcttggatttaatttggggtggggttgggtctctccagataccttgatttttaaagtaagtgttctgacatttaag

SEQ ID NO: 424064 - DNA, 2368 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424065 - DNA, 2804 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacaaaaaaaaacaaccaacccacacaaacacaacaagaaacacgcgaacgaaaaccccaacaccacaccgccaagacccaccacaagaccaacaacagacagcaaagaaacacagagacacatcaaccacacacaacccacagcaccaacacacggagggcgcgcggcccccactacaccacccgaccacccaagcaacacacgacgcgcgaccaccacaccagatgagccaacgagcgccccccagacgaggcaatagacaaacagaagacgcgggcgccgccagcaaagcacacgcaaacagaccaacaactcagacgcacgaataggaagagacgaacggcagggaggggagaagcggtaacaaccagagaaagaaggcaccgcaccacaaccagaatggacgcaaacacaacaggcgagccagccaccgaaacca

SEQ ID NO: 424066 - DNA, 2779 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaagaaaaaaaagaaaaaaaaaaaaacaaaacgaaagaggcggcggcggcgcgcgggcgagagaagactcactgactgaggaggaagcgaagcaacacacacacgccccaccgcggttgtgtcagatagcgagggagccgccaagacgaaggggcggggcgaaataaacaaaagacgagcgaggggcacgcgagcacagaacaaaaccaaggaaggcggaggaggagacaccgacgacaagaggacagcaaaggagaagagaaccccccacacaggggggagagaggagagagagggagaacaaccccac

SEQ ID NO: 424067 - DNA, 1673 bp, Homo sapiens
aggaactgtactccccctgccctaccacgatctgcccatattagcacgaatgactctgcacatcgctgccagtgtggtccataaatagggacgtgcttgcgattttctgagaaagaggcctcacgctgtagagtcccgaaagcccaggagttgaatggggattcctgtgaagtctctaaggtgtctttgttcgcagatgtctgtctatattgcttccatgatgctggatcgactgtactggaacattcgatgtagctaattgttgagcctgcaagcaggatgtatctcctactgaccccgattgtgtactggatggggccatcatgtatacactctggataatgtagctacactgtgtactccaagttcttcagcttttggactcttggacctacaccagtgatttgccgggggctttcaggccttcagctacagactgaaggctgcactgttggcttccctacttttgaggttttcagacttggactggcttccttgctcctcagcttgcacgatggcctattgtgggacttcaccttgtcatcctgtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 424068 - DNA, 2627 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagcctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaagaaaaaaaagaaaaaaaaaaaaacaaaacgaaagaggcggcggcggcgcgcgggcgagagaagactcactgactgaggaggaagcgaagcaacacacacacgccccaccgcggttgtgtcagatagcgagggagccgccaagacgaaggggcggggcgaaataaacaaaagacgagcgaggggcacgcgagcacagaacaaaaccaaggaaggcggaggaggagacaccgacgacaagaggacagcaaaggagaagagaaccccccacacaggggggagagaggagagagagggagaacaaccccac

SEQ ID NO: 424069 - DNA, 2063 bp, Homo sapiens
ttccggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcctctccagcttctgcagtgcattgttgatgaggattcgcccgtccttccagttggagagttctcggagccatttgtacatttcatcactcagtggtgagcccgtttacaaacatgccatgccctcaatgtaaatgatacatgccattaactcggcagctccgtgagaccttatggctctccctgcatccttttggagacaggagggacttcggggccttgggcagatggggcagcaaagctgaagaaattgtttaaattatgtaaacgttatttacacaaagggtcataagcatacttcagagcctttttcctgatttaataaactgctgaaagtcatgatacttctttaagcacaaatac

SEQ ID NO: 424070 - DNA, 1035 bp, Homo sapiens
cggccgcgaccgcggcagctcagcctcccgccgattgtatgttccaggcctcaatgaggagtccaaacatggagccattcaagcagcagaaggtggaggacttttatgacatcggagaggagctggggagggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacaaaaaaaaacaaccaacccacacaaacacaacaagaaacacgcgaacgaaaaccccaacaccacaccgccaagacccaccacaagaccaacaacagacagcaaagaaacacagagacacatcaaccacacacaacccacagcaccaacacacggagggcgcgcggcccccactacaccacccgaccacccaagcaacacacgacgcgcgaccaccacaccagatgagccaacgagcgccccccagacgaggcaatagacaaacagaagacgcgggcgccgccagcaaagcacacgcaaacagaccaacaactcagacgcacgaataggaagagacgaacggcagggaggggagaagcggtaacaaccagagaaagaaggcaccgcaccacaaccagaatggacgcaaacacaacaggcgagccagccaccgaaacca

SEQ ID NO: 424071 - DNA, 1313 bp, Homo sapiens
agtttacaaagccagtgctgaagaatttagggagttgattctgatgtaagaagacaatggataaagtatttttcagaagtcagtacaaattggcagcaaatctaccaaaaacaaataataagagaaaaactatcagtgatggatttatcttcacatgtagcatgtactggtttaaatcagtgaataactacatagttattgaattcaaaaacttttatttagacctggtcatctattctcttaattaaatgaaatgaagtttatggagattcacttataagtcatgtgttgcttaatgacagggaaacattctgagaaatgcattgttaggtgatttcctcattgtgcaaacatcacagagtatacgtacacaaatctagatggtagcacctattacacacctaggctatatgctatagcttattgctcctaggctataaacctctacagcatgtttctgtactgaattctgtaggcaactgtagcagaatggaaagtatttatgtatctaaacatagaaaaatatatagtaaaaatacagcattgtaatcatatatgtgggccattaggtgatgcataactgtaatatctaatatttaatttattagatagttatctcaaacatttagtatctagtaaataaacttattttatattactatctaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggctttta

SEQ ID NO: 424072 - DNA, 2893 bp, Homo sapiens
actaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttgatggatct

SEQ ID NO: 424073 - DNA, 2440 bp, Homo sapiens
actaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacaga

SEQ ID NO: 424074 - DNA, 3578 bp, Homo sapiens
  misc_feature (1)..(1): n is a, c, g, or t
ncctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424075 - DNA, 1813 bp, Homo sapiens
  misc_feature (676)..(676): n is a, c, g, or t
  misc_feature (1236)..(1236): n is a, c, g, or t
  misc_feature (1788)..(1788): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtaagtgttaccttcaaaggatttccttttctaaaaaattattttaaatgtctaactttatgttattgctcacgggtatttgactgaattgttgatttaggataagtcaattcctggagggaaattaccaaataaaatgatatgtatttcttaccacatctcttgatgctgattggcaaacctcttttcataaaaagcctgatgacttaaatccagcgtngagttgaaaattgccttcttccctgcacgttttctgtccccactgttgtcattagcacctgctagtcatagggaagttttctcaaagaacttgggaagtaggagtagaagcatgccttctgaaaaatcaaagtttaaaattaattcagaaagaattttcagcattctttttgttcagttttagaatcaggattatgtttactccttatttttattggaataaaacatacagaaaggtgcattcatcataaatgtacagcttggtaaattttcaaaaagcaagcatatccagggctgggcgcggtggctcacgcctgtaatcccagcactttgggaggccaaggcaggcagatcatgaggtcagaagatcgagaccatcctggccaacacagtgaaaccccgtctctactaaaaatacaaaaaattagctgagagtggtggcgggcacctgtagtcccagctactcggaaggctgaggcaggagaatgacatgaacccgggaggcggagctttcagtgagccgagatcgcgccagtgcactccaggctgggcnacagagcgagactcggtctcaaaaa

SEQ ID NO: 424076 - DNA, 1681 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgaggctcacagctggaggaaaatttgcctcaggatgaatcacacctttgggtctcatccatacctaatttagaggattctggatgagactctgacttcagacttttgagttgctgctggaatgactgacttttggggctactgagatggaatgaatatttgtgagaaggacataaattttggggggccagggtgagatgctatggctgaaatgtgtcccatacaaaattcaggtgttgaaacttaatggcaaatgtgatagtattaagaggtgggatctttaagaggcaattaggccatgagggtccctccctcatgaatggaattaaggcccttgtaaaagaggcctggccgggtatggtggctcacggctgtaatcccagcactttgggaggctaaggctcaagaatcacttgagcccaggagtttgagaccagcctgggcaacatggccagaccccaactcttaaaaaaatttttcaaaaattagctgggtgtcgtggcatgcacctatagtcccagctactcgaatcggttgagcctgggaggtcgaggttgcagtgaactgtgatcacgccactgcactccagtctgggtgacagagcaagacactatctcaaaaaataaaagaggtttcacacagggtttggccctcttgccgttctgttctgttgagtacacagccttccttccctcagaaagatgccctcaccagataccaaatgctggttcttgatcttggacttccagcttccagaactgtgagaaataaatttctgttctttat

SEQ ID NO: 424077 - DNA, 450 bp, Homo sapiens
agtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgaggaagaaggctgtctttgttctaagaatgccttgaacaaagcttcagaggaggaggttgccctgcttgacagaggagaagaatggtgcattttgatcctaaatggagaaaggagagggaaggaagaggaggaaaaaaacagcgggaaggagagcatgatactgagatgagctgaaagaccaataaagaaatgccacaatgaggtgtggctgggggctcttttgagatcagtgttgctgactgtttttgtgagagctgtgaatttgcgctgtta

SEQ ID NO: 424078 - DNA, 515 bp, Homo sapiens
  misc_feature (1)..(1): n is a, c, g, or t
ncctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgaggaagaaggctgtctttgttctaagaatgccttgaacaaagcttcagaggaggaggttgccctgcttgacagaggagaagaatggtgcattttgatcctaaatggagaaaggagagggaaggaagaggaggaaaaaaacagcgggaaggagagcatgatactgagatgagctgaaagaccaataaagaaatgccacaatgaggtgtggctgggggctcttttgagatcagtgttgctgactgtttttgtgagagctgtgaatttgcgctgtta

SEQ ID NO: 424079 - DNA, 4015 bp, Homo sapiens
agtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424080 - DNA, 4620 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtaggccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424081 - DNA, 4618 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424082 - DNA, 3196 bp, Homo sapiens
ccactataggaggaagaaaaaccatcaagaaggggaagaagcagccaagggcacagggagaacccagatggagtaacttcatggaagctgaggacttgggcgattcaaagaggaggggctgtctccagagtggattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424083 - DNA, 1603 bp, Homo sapiens
tgggtgtgagcaggtgacccctcatctgaaaggcccaaaccaggcggaagcaccagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424084 - DNA, 4142 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424085 - DNA, 1171 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgaggaagaaggctgtctttgttctaagaatgccttgaacaaagcttcagaggaggaggttgccctgcttgacagaggagaagaatggtgcattttgatcctaaatggagaaaggagagggaaggaagaggaggaaaaaaacagcgggaaggagagcatgatactgagatgagctgaaagaccaataaagaaatgccacaatgaggtgtggctgggggctcttttgagatcagtgttgctgactgtttttgtgagagctgtgaatttgcgctgtta

SEQ ID NO: 424086 - DNA, 695 bp, Homo sapiens
  misc_feature (1)..(1): n is a, c, g, or t
ncctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgaggtaagtcatggctgtcacctcagtggcccttgggcctttgtaccttgtcatttcagaatatgtgggtcattaagggagggtgaggatgggggagtgaagagaataggggaggtgagaggtgagaggaaggtaacaaattctctctacctgtagctgtctgtttatgtatctgtgtgtctgtctgtatctgagttgatacattgtgctgtatgctttttacattatatcatttggatctcacaacaaccctttaagatagatattattgttattctttaaaactttcaagaaattattatcaagtacataagttatttgctcattagaaaagttcaaacagtacaaatatgtttaagtagaaaaaagtatcctttaatcgtcctccctacttagttccctcctcttataggtaacagctgttaatggcttttaacatcaggttattaaggtat

SEQ ID NO: 424087 - DNA, 4736 bp, Homo sapiens
  misc_feature (676)..(676): n is a, c, g, or t
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcanaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424088 - DNA, 4080 bp, Homo sapiens
  misc_feature (1)..(1): n is a, c, g, or t
ncctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424089 - DNA, 3102 bp, Homo sapiens
cagccggacagtggtgtacaacaaggggttgtgagtgtggtcagcggcctggggacggagcactgtgcagccggggagctgaggggcaggcccgtagactcacggctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagc

SEQ ID NO: 424090 - DNA, 862 bp, Homo sapiens
gctgaggtgggaggatcgcttagctcaggagttcaagacccacctgggcaacatagaaagatctcatctctactagaaatttaaaaaaaaaaaaatagccagacatggtggcatgcacttgtagtcccagcaactcaggaggctgaggtgggagaattgcttgagcccaggaagttgagactgcagtgagctgtgatcatgcactgcactccagcttaggcaacagagcgagaccctgtccagagaaagagagagagggagaaatctccaatgaaaagtttttaagtcgtcaaacgtggggtgcttatcaaggaccaaagtctttcaacatgaaaaggtttatatataggtattttctggtgatggggatttatcataagaatgtttgggaaagtgagggggataaaaaaccttggcagcatagttgctaattactcttcatctcacttttttttgccatcctaacactacagtatcctcacatttctacacacgtaaggtagtctgaaatgtacttcctcaagggttacaggaaaggaaacttaattgataggaattatactttcttgctttgaaattactcattcctgaatggatgtactggtgaataatgaaattcccagagaacaagaataggaaagcactacgagatccaagtgacctgatagtacaccaactcatcagtccttaattagccaaaatttggccttggagactttttcctcaaacatacaaaaatttgcccccacttgactaatctgtcaatactcaagagttcttgtctaaaaacattgcacaaaacagagattgtgcaaaggctttcattttgatcctccacggtgcctcaaatataacaaatgtt

SEQ ID NO: 424091 - DNA, 362 bp, Homo sapiens
caggcttttgaccttggatttgccagcctccagaattgctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424092 - DNA, 2264 bp, Homo sapiens
caggcaacagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggccctactctagtgtccatagctccaaccattgagagtacctggctgaaatcaactttgctttctgtgggtatgacctctttcttcagaagctgtagaagaaacttgttgagataaactgcagcaagatatattgaggtcagctacgagggaggatgtacacacttgagtgaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgctgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424093 - DNA, 1875 bp, Homo sapiens
caggcaacagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgctgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424094 - DNA, 3930 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaagccttaattttctcccaagctttgacattgccaagggcagttaggagacttcaggatcaagtttaggggacaagtttttttctaatactttcaaaaggcccaagtgaagagaggaaggacacctcactttctggctctaaaagcatggtacatctcacactaggattccctctgcacctctgttcatccctgtattcctaactaaattccagaaaatcttccacaacactggagtcctatttttcttcttgagacctcctttgaagaaatcaacttggagactcctccttaaatccagtttctttctctacccaaaattttgcatctttatagaaaaagagataagtaggattcagagtctcttctcctagccattgtggggggaaaaaatgctatttctgttggcagaaaacaatacaaatattttttttaaatcatggcatgtttttaaagttaactaacagctgtagtttgctttggaagttaaatgttttgtcaataaacagggcttgagcacatgcagtgctctcttaagcagtatgtggtttcagagcatcttggacacatttctcccctgagaaaatattagtattaatagaatgggagaagtaagatgcacgcatttccagaagtatattatttggctgcctaataaattgtgagacaaaagaaaaaaaaaaaacaggaagagagggacttgagggaatttgagggaaatcataaccaaaagtttaaaggaaaaaattacaccagacatgataaacagaagttgattttgttctggtgctattgccagcattaggggagaaggcacaaactgagtctgatacgtagtgaggcagagacaaaagggctagggtggaaaaatttttaaaccatctgtgtttactaattccccataccaaaagaacaaaatgaactttctcctatttcatgataaaagatagtttcacaatttggaaaaagcccccccactccaagtttcctacccttcccacccacagaaaccaggagacaggggaactatcttccttgatgttaacatttcaaagaggtggttctcaggtcctagagaaagatattcctgagttgtaaaactgggaagaggctggaagaagatttagatctcaagaaatagaaagaactacagcaaattttctaaagcaaatattcttaagggaggtcaagggcctgaagtcaggaagaaacctatttggtcaagctgaggggaaagttaaggctatcttgtcacaagagaacagaaatatctgacaatatttcatttaaagaacttcactcattatacagtaccaaggggagatggtgctaaacgattaatgaaaactctacccagtaatccaatcaccacccaccaggccccacctccaacaatggggattacagtttgacatgagatttgggtgaggacacagatccaaactgtcaggcctctgagcccaagctaagccatcatatcccctgtgacctgcatgtatacatccagatggcctgaagcaagtggagaatcacaaaagaagtgaaaatggcctgttgctgccttaacagatgacattactttgtgaaattccttcttctggctcagaagctcccccactgagcaccttgtgacccccacccctgcctgccagagaataatcccctttgactgtaattttccactacctacctaaatcctataaaacagccccacccctatctccctttgctgactctctttttggactcagcctgcctgcacccaggtgattaaaaagctttattgctcacac

SEQ ID NO: 424095 - DNA, 2040 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424096 - DNA, 4184 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaagccttaattttctcccaagctttgacattgccaagggcagttaggagacttcaggatcaagtttaggggacaagtttttttctaatactttcaaaaggcccaagtgaagagaggaaggacacctcactttctggctctaaaagcatggtacatctcacactaggattccctctgcacctctgttcatccctgtattcctaactaaattccagaaaatcttccacaacactggagtcctatttttcttcttgagacctcctttgaagaaatcaacttggagactcctccttaaatccagtttctttctctacccaaaattttgcatctttatagaaaaagagataagtaggattcagagtctcttctcctagccattgtggggggaaaaaatgctatttctgttggcagaaaacaatacaaatattttttttaaatcatggcatgtttttaaagttaactaacagctgtagtttgctttggaagttaaatgttttgtcaataaacagggcttgagcacatgcagtgctctcttaagcagtatgtggtttcagagcatcttggacacatttctcccctgagaaaatattagtattaatagaatgggagaagtaagatgcacgcatttccagaagtatattatttggctgcctaataaattgtgagacaaaagaaaaaaaaaaaacaggaagagagggacttgagggaatttgagggaaatcataaccaaaagtttaaaggaaaaaattacaccagacatgataaacagaagttgattttgttctggtgctattgccagcattaggggagaaggcacaaactgagtctgatacgtagtgaggcagagacaaaagggctagggtggaaaaatttttaaaccatctgtgtttactaattccccataccaaaagaacaaaatgaactttctcctatttcatgataaaagatagtttcacaatttggaaaaagcccccccactccaagtttcctacccttcccacccacagaaaccaggagacaggggaactatcttccttgatgttaacatttcaaagaggtggttctcaggtcctagagaaagatattcctgagttgtaaaactgggaagaggctggaagaagatttagatctcaagaaatagaaagaactacagcaaattttctaaagcaaatattcttaagggaggtcaagggcctgaagtcaggaagaaacctatttggtcaagctgaggggaaagttaaggctatcttgtcacaagagaacagaaatatctgacaatatttcatttaaagaactgtattagtccattctcacactgctataaataaatacctgagactgggtaatttatacagaaaagaggtttaattggctcacagttccgcaggctgtacaggaagcatggcaacatcagtttctggggaggcctcagggagctttaactcatggtggaaagcaaagtgggagcaggcatcttacatggtatgagcaggaggaacaaaggaaaggggaggtgctaacacttttaaatgaccagatcttgtaagaactcactcattatacagtaccaaggggagatggtgctaaacgattaatgaaaactctacccagtaatccaatcaccacccaccaggccccacctccaacaatggggattacagtttgacatgagatttgggtgaggacacagatccaaactgtcaggcctctgagcccaagctaagccatcatatcccctgtgacctgcatgtatacatccagatggcctgaagcaagtggagaatcacaaaagaagtgaaaatggcctgttgctgccttaacagatgacattactttgtgaaattccttcttctggctcagaagctcccccactgagcaccttgtgacccccacccctgcctgccagagaataatcccctttgactgtaattttccactacctacctaaatcctataaaacagccccacccctatctccctttgctgactctctttttggactcagcctgcctgcacccaggtgattaaaaagctttattgctcacac

SEQ ID NO: 424097 - DNA, 2140 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424098 - DNA, 2261 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggcaaattaaatactactgactctcactggaaaagaatatgaatatgtgtgagtttttccatgaaaaagctccttggaaaatgtagtaagtgacttcaacctataagactgtttttggtttagatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaa

SEQ ID NO: 424099 - DNA, 2676 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaaaaaacaacaaaaaaaaaaaaaaaaaaaacaaacaaaaaaaacaaacaaacaaaaaaaaaaaaaaaaaaaaacaaaacaaaacacaaatacaaacaaaacaagggggcggggcgcccgggccggctaatgatactcgggggagcgaggtgatcaaacaagcaaacaccagtaaagttttccgtatctatgcagatcagaacattaccacaacacacacacaactccacgagaagaatatataatagtatctatcagaacccgaccagaaccaacggacagacaacatcaagcaacaaaagccgatgcatagatagaataagaaaaaagaggacagcgacaacccactaagcgagatcgcagcagcacgagcagaaacacacagaaagcggagagaataacgacgtgagacggcaagggaaagatagaaacaaactgagtgagcgacccgaaaacgaagccaatacaaccacacacaaagaacgaggagatagataagaaaatcaatgaagcagcgatgcaggctacaagtaacaaaa

SEQ ID NO: 424100 - DNA, 2000 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424101 - DNA, 1904 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424102 - DNA, 1981 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424103 - DNA, 1958 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtgtatacatgtgccatggtggtttgctgcacccatcaacctgtcatctacattagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424104 - DNA, 2025 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtgtatttagcactgtaaacttgcctcttaacactgcttttgctgcatcccagaaattttggtctagaagtacttgtatgaatctgggtgctccagtgttgggtgcaaatatacctaggatagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424105 - DNA, 1739 bp, Homo sapiens
  misc_feature (11)..(11): n is a, c, g, or t
  misc_feature (13)..(14): n is a, c, g, or t
  misc_feature (22)..(22): n is a, c, g, or t
  misc_feature (34)..(34): n is a, c, g, or t
  misc_feature (36)..(36): n is a, c, g, or t
  misc_feature (44)..(44): n is a, c, g, or t
aataggggggntnnattttatntagtgaggggangnatggcttntccctggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424106 - DNA, 1577 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcgttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424107 - DNA, 1854 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagactgccctttggatgtttaatcttcattaataaatacctcaaatggccagtaactcaaaattact

SEQ ID NO: 424108 - DNA, 1658 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcgattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactctta

SEQ ID NO: 424109 - DNA, 1531 bp, Homo sapiens
ttcccttatatttgcttattcagtaatttagttacttgctacttacatttggtattaattcactaatttcagctaattaaaatcaaacgtacaataatatcctaattttcttgtaatagctactaaaatatagttataatagagaagtgtgttcaagtagttaaaaattaccacaagatttatgttcacaaattttcctatgagaatttttcgtctccaaacgttttgagagaaaaaataaatttttctgcttagtaaatttctcaaccttaaaacaagatgctggcctagggctaggagaggacttcttagttgaagctcctgcttctctggacaactttcctcttccttcttgcaaatgctttgcagagggacttgcacctctgctgctggacctggtcaggagcaagaggaaatttaaaacattcctcgggagtgcttgctcccagtggattgcatttgattgcgccttgtccttcgttgctttctttttgtgttgtttaattctgcttgttttttactgctatggatgttgcagatatctgtgaaattttactctattaggtcatcacctttagtaaatatttatccttgcataatttgagaaggtagacatgtttgttttgtaatattccccttagtaatatgagatagaagtacattggtaatggtagagatagatatttctaattaggtactaatgtttcttacagttttcagaataagtaaggaataatttttatgctatatattgccttccttttacagtgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaattact

SEQ ID NO: 424110 - DNA, 1305 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccaaaaaaaatt

SEQ ID NO: 424111 - DNA, 1024 bp, Homo sapiens
ttcatgggtaaactccactggtcaataatcaagtcactatctctatattggaggcaaaggattgcacaattcaggctatttgtaatgttgctttggattgtagagacttagactcagaggaatcacgggacatagaatctagaacaggtctgtgtcccatcattctcttaaaagaaaacctttcaagtaatatttcttattatcttttaaaatcttgttaaaatgacaaaatatatatatatttgtaatttttaaaattttgatgcatacaaagatagacatagatagatagataatgtagaagtataaataataataagtcactagagcatgactaactagtgaagttacccagtctcctctccatcccatctctctgtctcccatccactctacccaactcttcctttcaaagagtaggatttttctgcttcgtttttttactgctttgttcttacttagggttgctggaagcacatggaaggagggaagtagtcaaaacaagacagtgttgtgaggggagagatgagaagtcatgataagtaggtgggtgggtgacccacagggctggcatcagaaggaaacatagcaaaacatgatggatatgaggcttgctgtggggagggggattggcctttgtgagtggcagccgcctgctcccttcccgcttcccttagtgctccattgagctagcagcatgcagctgagaagttgaagttctgaccacatggcctctgctgccactgctctgccccatcccaggcacctagccagctctgcattaaggaggtgaagtggatgcccaaggaaagaagtgcccccaaggagacttgctgagaccttgaacaagtgacacaatgtgagcagaacttgtcttgacagaaaatgctttgtctctaggtgttccagagagatgggcaagtgtcctatttcttagtgagagcctctaaacaaaccagcttgtgaacctccactgaaaagatctcatctgatgagcattttaataaagtgtcctgagtttgga

SEQ ID NO: 424112 - DNA, 762 bp, Homo sapiens
atgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggagagaatgaataatggggaaagaaactgaagagaaagtaacaggcaaggagatatttgcaggaggtatctcatggagagggcgtcttggcctgctcccctctggggccactaactcacaccagagctgactcaaccattccaggggaagattggtaagaagtttattcaccagacatgtctagctgaaatgaatgaaatcaaactcagcagaagtcaacacttagcacggaaggcaaagtagagacaaagggtcacccggctgctgcacaccggcctttagctttagctcaagttgttctgctttaaaggacaatgccaatcatctcataagtaaatgaagacaatgattcaacagtgctgtcaagtttgagagaaaagagaagccatccctacacccaacacttaatatattgttaggcttggggtgggttgcccagtgccttctgggatgacctgtgctcttttcttttatccaggagcaattagaatcaatctgcttcatctggaagttctgcccaagggtctggcaccataggaagttgtccaggattattttaaccc

SEQ ID NO: 424113 - DNA, 809 bp, Homo sapiens
atgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggctctgattctaaatccctgaagtggttgaacactgtgtctgaggccagaagctttcgtgggtcactagaaaagagcctagtgagggggaggaactggactggaacgtggaaagctggaatcgggtctgacctgccctgccgccttggcaaatcactcctacaggccttcaactgattggatgaggcccaccaacattatgaagggcaatctgctttactcaaagtccattggtttaaatgtaagtctcctcccaaaaaaccctcgcagaaacatccaaaataatgtctgaccaaatacgtgggcattgcagcccagtcacgttgacatatgaaattacccatcatggggatgaaaactggtgagtcactggcatatgaatagctggcatgactgtggactctggggagagagaagagaaggagaaggcagggcctaaggaacatc

SEQ ID NO: 424114 - DNA, 638 bp, Homo sapiens
atgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggtagtagagttgacctggagccagtgacctgacccttttgaatctctgtttctgtgtttataaaatggtgacaggaagattgttcagaggatgaaatgagaaaatgcacatagagtaactcatgctcaaaatgaaaaaaggtaaattcccttatctattgagatcgatcaactgttttctgtatctcagagaatcaaccatcaactgcacacaaataaaaaagctctgggcaccgtatcaagccaagaacagcccaatctcctttctgggcaaac

SEQ ID NO: 424115 - DNA, 4524 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424116 - DNA, 4783 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgaaaaaaaaacataaccaaaaacaaaaaacaaccaaaaaaaaagcacaaaaacacccaacaacaaaaaacaaaaaccactacaacagaacagaacacaagcgaggacatcaaaaaactaaacatacaacagcaaagagagacacaaacagagaacagaaacaaacacaaaagataaggacatcagacaaaaaaaagcgcgcaaacagaagcacagacaaacaagtgaggaacacaaaacaaacccaaaatagacaaccaa

SEQ ID NO: 424117 - DNA, 4290 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagggctttcccaacccaggatggctgttctcagcgtgattcacaagcatcgcggccctcacgatcctgcacggtgcttccacacaccgggccctacttccgtctacccgcccaggacatttaacgtctccttccttccagggccggcccgtggcgcgggcg

SEQ ID NO: 424118 - DNA, 4475 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424119 - DNA, 4713 bp, Homo sapiens
atgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424120 - DNA, 4077 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424121 - DNA, 3855 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424122 - DNA, 3113 bp, Homo sapiens
atacaccatttggtagcatgaggaaagaaggaagaaagccagcacctgatgcatctgactctgggtaaaacccccttcttttaacagctctgggggactaaatattatgatgcacaattcccattcagactgccttagaaactttttttccttaagtgctcatatatttatatgcattaatcttcctgtagtgctggatcataacatgtctatcaatcttcacagaaagagtaggataaacagaaaggggtcatgaatggtcatttcatctgagcatcctgagatagtagaggctttctccgagaaggagcaaactgtcagtgacttacttgacaaggaggtcactacatttggttttcccttgccacccctcaacattaataaacatttacatagagcctactacataccaaactattataagcacttggtaaacgttaactcatttaacctccataaaggtgtaggtaacagggctgcggtttaaacactatgctaccttctagccagagggtacaagagaccagtagtccaatcatagaaggtctgagcttgaggatcatctttcccaacgtctacattttacaatttaggaaagcaaggcagcttgacccaggctttacagctcacatgcatctgacagttactagcgactaaaatccctgtcttttaactccaaggcctagtgaatttccattgcaacacactcccttgctctaatgagatctgctttcgtcttccttgcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 424123 - DNA, 3268 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagacaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgttttgaaaactcttttcaaaactgaccatcttgtatgtagaggctatttttaaatcattaaatttttagatctctg

SEQ ID NO: 424124 - DNA, 2607 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacgggcgaggtggaactgggcccccaaaggggggaaaacccaaattttccccgggccaaaaactcaaaaaaaaggggttcccaaatttgggaaaaaccctttccccccaaaaggcccaaaaaaaaccccccaaaagggaccatttcccttggg

SEQ ID NO: 424125 - DNA, 2616 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcaggtaagttcaatcagagcaaaaactgcttggcattggaaagatttcccacctagcactaaggaaaggtatcacttcaagagattatgattttgattcttccagctcactggcaggaatcagctccaaagcacggaatggggtttaaaagcaaagagaaggtttatgaccttgttagttcaactgggtgtacctgggttccatctaaacggcaatttttttaaaggctaaacctgcatatctaacatatgaggactatttgggttaaggcatttggtctcaagaaacaagacccattcaagctagcctaagcaagcaggtttatagtaaagccacagtaggggaattcagtaacagaaagtgaagatagagccaggtctggggagaactagaactgtaaattatctctccttcttgtagttcctttgcttctttctatcagtctacttcactctcaccta

SEQ ID NO: 424126 - DNA, 1443 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggcacctagccagctctgcattaaggaggtgaagtggatgcccaaggaaagaagtgcccccaaggagacttgctgagaccttgaacaagtgacacaatgtgagcagaacttgtcttgacagaaaatgctttgtctctaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccaaaaaaaatt

SEQ ID NO: 424127 - DNA, 1583 bp, Homo sapiens
ttcatgggtaaactccactggtcaataatcaagtcactatctctatattggaggcaaaggattgcacaattcaggctatttgtaatgttgctttggattgtagagacttagactcagaggaatcacgggacatagaatctagaacaggtctgtgtcccatcattctcttaaaagaaaacctttcaagtaatatttcttattatcttttaaaatcttgttaaaatgacaaaatatatatatatttgtaatttttaaaattttgatgcatacaaagatagacatagatagatagataatgtagaagtataaataataataagtcactagagcatgactaactagtgaagttacccagtctcctctccatcccatctctctgtctcccatccactctacccaactcttcctttcaaagagtaggatttttctgcttcgtttttttactgctttgttcttacttagggttgctggaagcacatggaaggagggaagtagtcaaaacaagacagtgttgtgaggggagagatgagaagtcatgataagtaggtgggtgggtgacccacagggctggcatcagaaggaaacatagcaaaacatgatggatatgaggcttgctgtggggagggggattggcctttgtgagtggcagccgcctgctcccttcccgcttcccttagtgctccattgagctagcagcatgcagctgagaagttgaagttctgaccacatggcctctgctgccactgctctgccccatcccaggcacctagccagctctgcattaaggaggtgaagtggatgcccaaggaaagaagtgcccccaaggagacttgctgagaccttgaacaagtgacacaatgtgagcagaacttgtcttgacagaaaatgctttgtctctaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccaaaaaaaatt

SEQ ID NO: 424128 - DNA, 746 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgttccagagagatgggcaagtgtcctatttcttagtgagagcctctaaacaaaccagcttgtgaacctccactgaaaagatctcatctgatgagcattttaataaagtgtcctgagtttgga

SEQ ID NO: 424129 - DNA, 884 bp, Homo sapiens
tgaattcgtgagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggcacctagccagctctgcattaaggaggtgaagtggatgcccaaggaaagaagtgcccccaaggagacttgctgagaccttgaacaagtgacacaatgtgagcagaacttgtcttgacagaaaatgctttgtctctaggtgttccagagagatgggcaagtgtcctatttcttagtgagagcctctaaacaaaccagcttgtgaacctccactgaaaagatctcatctgatgagcattttaataaagtgtcctgagtttgga

SEQ ID NO: 424130 - DNA, 385 bp, Homo sapiens
gcttggaaatttacacctctgtgccttctctcccacaggtgataacccccgtgaggacaggccatggctacgtatacgagtacccatccagataccaaaaggacgtctatgatatccctccttctcataccactcaaggggtgcgtaccagaacatggtcacaagaggagaagcgcttctaagggtagcattccttcagggctgtagagaaaagggagttcacaaattatgcattaatatatgtcatatgaagctttgtttaggttgtctacccagtagccactttagccaatgctatttaaattatgttttctggatttgctttatcaggaaatcctagtatttcacccaagagagcttatgttcttctacaattttgcttcag

SEQ ID NO: 424131 - DNA, 498 bp, Homo sapiens
ggccatatttgtgcatttgtcttagggccctcttgagggcttagcacttctctctgacccaggcaagactttatgtgctgtgcattcctcctgaacatgatgtcatgcttgtgcctcaccatggaattctgcagccaggcactggggctcaagtccaaagacgggaagacttaaaaggctcaaacaagcaaatgtttgtcattatttaagattttaagacaactgaattctgaaatgtttatggtcctggcctcctttgtgggtcatcaatgacctcttcccttttaggaggtatctcatggagagggcgtcttggcctgctcccctctggggccactaactcacaccagagctgactcaaccattccaggggaagattggtaagaagtttattcaccagacatgtctagctgaaatgaatgaaatcaaactcagcagaagtcaacacttagcacggaaggcaaagtagagacaaagggtcacccggctgctgcacac

SEQ ID NO: 424132 - DNA, 491 bp, Homo sapiens
cagcaaataggactgagcacatgggaccacaggttcccatgagccaactcaataaatagcatttcgctttctacttgctttgcaggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaag

SEQ ID NO: 424133 - DNA, 607 bp, Homo sapiens
acaagccatcaggttcttcatggggcaggtgaaatacttctaccccatgggtaaatgtatttacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagcgtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttaga

SEQ ID NO: 424134 - DNA, 257 bp, Homo sapiens
actgggagattccaaggagaggaatgacaccggctaatacttgaacaagatcactacatcttgtcttctctgttgctcctggactgcaggggacaagtgtgaaagcagggagaccagctggggagctaccacaacagacggaagaaccagatccaatgatatgtgtaagaagaataatttcagtgcaattgaaagaacagatgcacaattgactctgtcaagtgatggaatgacccgtctcaaataaagccaatgag

SEQ ID NO: 424135 - DNA, 391 bp, Homo sapiens
aaattttcctttttaatttcttaaattaaatgtgtcttcccaaggatgcccagaaataggaaagttacataaatgctaattaaaaacatgcctgacaagctgtgcccactagtcccgttgatcattctttaattcacatttcacagcaatttctaagaacatcaccacgtccttcattaactacatatcaattaaaatacctctgagaggcaggtacaataatgcactatatattatccttgaaaactgaaaggcccactttgctaactgctacacacagcacatagagacttagagagagaaggaaaaaaaataaagcctgcccttaaggatttcgcagacgatgaagaaagacattttttccaatgctgtacaaaaagaaaagaaagaa

SEQ ID NO: 424136 - DNA, 349 bp, Homo sapiens
ataaagaaataaaagtaatttacctataattcccatccttagatcctaattgccttgctgtgattttgaaaaactgacctacactttttgtgcattatatgtatgtcaatatagtttaagtcatattatataaaaatttcgcatttggcttttaacaaatataagacaaacacaaggtttttgttaacataattttaaatacctgcctgatattttacttaaataacgtgtttagatttctaaggctgtgctattataaatcttgttactctgaacatctatttttacacaagcttcttccacattccgggaacattttctagaaggcggaaataaaattgtgttatat

SEQ ID NO: 424137 - DNA, 755 bp, Homo sapiens
tacccagttcgacggagactctccttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424138 - DNA, 1025 bp, Homo sapiens
aatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttgtttacatttttcattgcttgaataattataaaatcttaattttc

SEQ ID NO: 424139 - DNA, 485 bp, Homo sapiens
aaaaaaccccccccctgggcacaccgagcccccaaaccttaaggaataaaaaaaaaaaaaaaaaaaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424140 - DNA, 2949 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttg

SEQ ID NO: 424141 - DNA, 3881 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424142 - DNA, 3827 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424143 - DNA, 3827 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424144 - DNA, 3828 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctatgagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424145 - DNA, 3816 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424146 - DNA, 2771 bp, Homo sapiens
aatatctgatatttcagaggattataagaggcactaaacactgaactctgactcttctaattttggcttctaaactaatttgtctgaatttatttgctattctgaagcttaatatggaaattgacatagaaaatatgcagcagttgctgtttaatcatgttgctgtttatagttgcaatatctatcacctgtttctttgagtttttgttttttatcaaatattttaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424147 - DNA, 2840 bp, Homo sapiens
  misc_feature (2762)..(2762): n is a, c, g, or t
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaaaaaagcctctaatactggtgatgctagaggtgatgtttttggtaaacaggcggngtaagatttgccgagttccttttactttttttaacctttccttatgagcatgcctgtgttgggttgacagtgagggta

SEQ ID NO: 424148 - DNA, 2331 bp, Homo sapiens
aatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424149 - DNA, 2585 bp, Homo sapiens
acttgtacactagataaatatcaaaacagccaaggtgaaagtcatcaaaatggaacttttttcttttaacaaagataagtgcttttttgtgttggaagtaaatttgtcagtggagcaagcaagcattttgatttatatagcatgataagaaaccatattgctgttaccttgggagagttcacacttatgaagggtagatgagatatggacaattcaaagcagccagtctatcacatatatgtataaatgaccatgaagtcactttttagtttatatttcaatctttctgcatgttgtactctgtaccctggctcacgaaggtgggaggttgtcattttttgtcttagttcaccgtgatgttctcagtgttatgtgcttacagtctgtgccatctttcagactttcctctaagggggaaatggctttaatggagctctcaatgtaaaatagatgcattaacaaaatatggacgagagtagggagatcatcacaaagaatagctaatggatgctgggcttaatacctaggtgatggggtgatctatgcagctgtttaccatggcacgtgtttaactatgtaacaagcctgcacattaacccctgaatgtaaaataaaaattggaaaaaaaaaacaacccaaaatacaagtaaacaaattaggtgcttttaaataaacttgaaagatttgctgtgaataaattagtttttatatcttccctttggaaaattagtatctaactactgatatatttttaaatgtttttcagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424150 - DNA, 3044 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaatttacagctc

SEQ ID NO: 424151 - DNA, 2575 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttgtttacatttttcattgcttgaataattataaaatcttaattttc

SEQ ID NO: 424152 - DNA, 2009 bp, Homo sapiens
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatggacagtgggagaaaacacagatgcctggaaaaggattttgggaacattatgtgtggagggggaaccacctcagata

SEQ ID NO: 424153 - DNA, 821 bp, Homo sapiens
  misc_feature (821)..(821): n is a, c, g, or t
ggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagatatagtaacctgagagaacaaggtgtcn

SEQ ID NO: 424154 - DNA, 1098 bp, Homo sapiens
  misc_feature (1)..(1): n is a, c, g, or t
  misc_feature (3)..(3): n is a, c, g, or t
ngnggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424155 - DNA, 1039 bp, Homo sapiens
  misc_feature (1)..(1): n is a, c, g, or t
  misc_feature (3)..(3): n is a, c, g, or t
ngnggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatgcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424156 - DNA, 800 bp, Homo sapiens
gccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagagaaaaaaaaaaaaaaaaaaaaaaaaaaaaaaaaaaacggcacgccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424157 - DNA, 1156 bp, Homo sapiens
ctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424158 - DNA, 1073 bp, Homo sapiens
  misc_feature (1)..(1): n is a, c, g, or t
  misc_feature (3)..(3): n is a, c, g, or t
ngnggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424159 - DNA, 786 bp, Homo sapiens
  misc_feature (1)..(1): n is a, c, g, or t
  misc_feature (3)..(3): n is a, c, g, or t
ngnggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgg

SEQ ID NO: 424160 - DNA, 867 bp, Homo sapiens
ctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtgggtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424161 - DNA, 896 bp, Homo sapiens
  misc_feature (1)..(1): n is a, c, g, or t
  misc_feature (3)..(3): n is a, c, g, or t
ngnggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424162 - DNA, 659 bp, Homo sapiens
tagagtttaggatctgatagtgaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactga

SEQ ID NO: 424163 - DNA, 499 bp, Homo sapiens
ctgtaatcattctccttttcccagtatcttaaaccacactataaaatcagactatgccaaaatagtaagaaaatatgctacttacagggaaatccagtttctttcttgcatgttcatttctggggaacacaggggctgtgggagccgtgcagggcagttactcactgctctctccccgcagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgggctgcacctgggccgcagctcttctcatactgaattcagaaaggtaacgctgggtaagaaaatcggcttccgccagagaagaaagtccagatatctcaggtcctgtgaataacttagtttctctcgcata

SEQ ID NO: 424164 - DNA, 1090 bp, Homo sapiens
gccaggtgtactttttgggggacagcaaatagccctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaggcaagaacttgcaccatcccactgttagacctctgggggtacagcaagacacgttagcaattttcactcacaattggggaatcccccattgtcccctatagggcccatgtggcatctacaacgaccacttgaagtggtgggtaagtagcatgaggcaatttcaagttcccactgagggatccccagagtgggggacacgcgacgcgacacaatgagtacgaagtgaagagagcacaagataaccccacacgaaagacgcggcacaacagagggggacacaccgcgagtcaggcgcacaaaaccacagatgagcaccaagaccaaagatgaccgggacacagccagtgagatacaccag

SEQ ID NO: 424165 - DNA, 2518 bp, Homo sapiens
cgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaaaaaaaaaaaa

SEQ ID NO: 424166 - DNA, 2060 bp, Homo sapiens
cccggcggggctcgcggctcccggcagccgccgcctcccctcgcggcacttccggaccccggcgtcgcccttttaaggggcagcccccaagcccagaggcaggacttcgcagcaggatggggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaaaaaaaaaaaa

SEQ ID NO: 424167 - DNA, 1619 bp, Homo sapiens
gccaggtgtactttttgggggacagcaaatagccctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaaaaaaaaaaaa

SEQ ID NO: 424168 - DNA, 1858 bp, Homo sapiens
cgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacatttcccactggtctgaaagtggtccagtcggcaaatagaaccgtcagttaggc

SEQ ID NO: 424169 - DNA, 1612 bp, Homo sapiens
cgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaaaaaaaaaaaa

SEQ ID NO: 424170 - DNA, 1876 bp, Homo sapiens
cgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttgaacatttcccctgagtctcgaagtggtctccggtcggcaactagtgcctgtccagtcggaaaagctgtttacagcttt

SEQ ID NO: 424171 - DNA, 1989 bp, Homo sapiens
cgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgattggggatgaaatctgttgtaacaccagagcttggattacacatcctctggtttggagttattctacagaatcagaaaggctggaaggtgggcttcacactcaggatggtgctttgagaaccagctaatagaccagccgagggaaggttgaatgggctgtctttacttttcccgataagccctacttaaatgcagcctgtaattgtataaaggagatgagaaacatcaggcaagaacttgcaccatcccactgttagacctctgggggtacagcaagacacgttagcaattttcactcacaattggggaatcccccattgtcccctatagggcccatgtggcatctacaacgaccacttgaagtggtgggtaagtagcatgaggcaatttcaagttcccactgagggatccccagagtgggggacacgcgacgcgacacaatgagtacgaagtgaagagagcacaagataaccccacacgaaagacgcggcacaacagagggggacacaccgcgagtcaggcgcacaaaaccacagatgagcaccaagaccaaagatgaccgggacacagccagtgagatacaccag

SEQ ID NO: 424172 - DNA, 580 bp, Homo sapiens
gcccctcgcgtaacctgcgcccttctcgcaactcgcgtgcctcacagatcccaggtgctgcgcagctcagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaaaaaaaaaaaa

SEQ ID NO: 424173 - DNA, 2411 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424174 - DNA, 443 bp, Homo sapiens
cctggacaacgtggtgaaaccctgtctctactaaaaatacaaaaattagccaggtgtaatggtgggcacctgtaatcccagctactagggaggctgagaatcgcttgaacccgggaggtggaggttgcagtgagccaagatcgcaccactgcactccagcctgggcgacagagtgagattctgtctcaaaaaaaaaagaaaacacctcctctccttactcttgtttccagatcctgcccctgagctttcatgagctgttgaaccatctggaattcacaggcctgtcatgagagacacgatgagaagtccttaggtagatcactgattcacaggggagcaggcggaggcaagggtgagtcagtgcttggaactcagtcatccagatttggctctggaaacttctgaagctgtagcctttggggatccctgactgcgagtacagg

SEQ ID NO: 424175 - DNA, 2767 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaaaaaaaaaaacagcttttttgtacacatacaatctaaatattacttctaaaatttcccaccgatctctttcaatttcctcgtaaaataaaaatttctgggggggggcctagaccccattttgccctttgggtgggtgcttttaaattacagtggccgttttttaaacccttgtgactcggaaaaacctttggttatcccaaattaatggcttttgaaaaattccccttttgccagttgcgtaatttcaaaagggcccctcactcatgatttttcccaaattttggcacccttgatgagctaatgggaatatttacccgctaaatttttgtaaaatcccgtataaatttttggtaaa

SEQ ID NO: 424176 - DNA, 2203 bp, Homo sapiens
gcctggtggcgaattcggcacgaggaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424177 - DNA, 2030 bp, Homo sapiens
aggagactctgaggatcccccgtccgtcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424178 - DNA, 2127 bp, Homo sapiens
cccccgtccgtcgaccgctcgtcggtcgaccgctgatctttataatagatacagccaaaatctgtcactcatggtgagaataagagtcaaagcttatagttaagcggtcgacggacgcgtccgtcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424179 - DNA, 2258 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424180 - DNA, 2022 bp, Homo sapiens
gcggccgcccaggtccggagagcggggccgcctcggagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424181 - DNA, 2441 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacgccctaaccgcgtcctgcgactttcgtcctccagctaacagccgaacatctagatcgaccgcacagagcggggagggggcaggggtccacacaagagggccagattgtggtccgtgagtcaagatgcccatcacactcgccgaccgattccgtcccttcgtccagctccaaaccgggcggtaatggggtccaggaaggctaaagggaacacgcacagccaccgagggaggggtctcaccaaagaacacccacttaa

SEQ ID NO: 424182 - DNA, 2505 bp, Homo sapiens
ttcctgtgcccgttgatgattcaggctggcttctgggcttgatctggagctgactttttgtgcaaggatggtggcagtgaatgctaatgtgtgaggatttaaaaactccctatttatttttgtttttttttttcttctcttcctacgcaccattagccctaaaacgttgagagtaaacacttaccgaaagccgaccctggaccatgtgtctttagccatctcttggtgatgttgccaggaggatgggtcagtccaggagtggcagggcctaggtggcacctggaggtgaacacctaaccgcatgagtccttttccactgtcaggctacgcggaaatactgttggtaggggggcgtctctgctgttggcagtgagaggtagaaacttggggttcttccttgctctcccctgacagacaaaaaagttcctcccccatggcttccaagctgtttccccctgtaagggaagctcgagagagagtctgctgttcagccatctgactgcttctaaatccgcttttcaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424183 - DNA, 2223 bp, Homo sapiens
cgctgtggaaaccaaggtaagcgacggttaggccagacgcgggggcggggtaagaagttgagtgacaggcaaggcagcatccacatgacaggcggcgccgaaggggtaaattctgagatcctgcccctgagctttcatgagctgttgaaccatctggaattcacaggcctgtcatgagagacacgatgagaagtccttaaaggtagatcactgattcacaggggagcaggcggaggcaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424184 - DNA, 2357 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424185 - DNA, 2052 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattcagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424186 - DNA, 2330 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424187 - DNA, 1966 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctccctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424188 - DNA, 1346 bp, Homo sapiens
cgaggatctgcataaacagggttcctgacctcaccgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424189 - DNA, 1376 bp, Homo sapiens
  misc_feature (48)..(49): n is a, c, g, or t
  misc_feature (56)..(56): n is a, c, g, or t
agagctggccgggattataaatgaacacatgctccttcttctgtgtgnntcagttngtgctttattctgtatttgtctcccatgtcttgctcttctcctggagaattctgtcttctctttggccattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424190 - DNA, 1324 bp, Homo sapiens
ataggctaggtacgaggctgggtttaaattcggccgaggctccccaaaacactcgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424191 - DNA, 1635 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattagtgctcagacctttagactcattgtaagttgccactgccaacatgagaccaaagtgtgtgactagtcaatgaagtgcgacagcattaaagactgatgctaaacctcaaaaaatatctccaggcgtgaccacatacccattttcccctttaactaagtcctttcact

SEQ ID NO: 424192 - DNA, 1214 bp, Homo sapiens
gcagagctcaaggatttctggaaaggtcccggtcagtcctggggagctcagatagctatatggaagaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424193 - DNA, 1266 bp, Homo sapiens
caccttttcaaggacaacttcgcacctctcaggttcgtcacaaatattggactacctacctggggacactggggaactcacgatcagtccgttcgcatgttaacatgcgaacggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424194 - DNA, 1196 bp, Homo sapiens
  misc_feature (43)..(43): n is a, c, g, or t
aattcgcggccgcgtcgacacggactgcgagaagacgacagangggggaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424195 - DNA, 1479 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagtgctcagacctttagactcattgtaagttgccactgccaacatgagaccaaagtgtgtgactagtcaatgaagtgcgacagcattaaagactgatgctaaacctca

SEQ ID NO: 424196 - DNA, 1529 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagaagttcttttgccccttttgggctttctcactgctgatgccttccgctccctttttccatctttcaaggggtacactaactccagggggttcagccttaagtatatcgtggtggcaccataagtactgcttggcatggttgaggcttccacaaatgctttaccctctggctttctattagatgtcacaatcgtgactgcaattct

SEQ ID NO: 424197 - DNA, 1324 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctgaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctca

SEQ ID NO: 424198 - DNA, 1000 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggtcgacggacgagcggtcgacggacgagcggtcgacggacgagcggtcgacggacgagcggtcgacggacgcgtccgtcgaccgctagttctatagggctccaaagcctgacctcttttttgtcaaatagagtgctgcctcctaattctgagagaaatagagtcatttggttcaagactcaacttctgcggtggaaccgtacacagatgtttctaac

SEQ ID NO: 424199 - DNA, 664 bp, Homo sapiens
gcggccgcctactactactactactactactgctcgaattcaagcttctaacgatgtacggggacatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaaaaaaaaaaacagcttttttgtacacatacaatctaaatattacttctaaaatttcccaccgatctctttcaatttcctcgtaaaataaaaatttctgggggggggcctagaccccattttgccctttgggtgggtgcttttaaattacagtggccgttttttaaacccttgtgactcggaaaaacctttggttatcccaaattaatggcttttgaaaaattccccttttgccagttgcgtaatttcaaaagggcccctcactcatgatttttcccaaattttggcacccttgatgagctaatgggaatatttacccgctaaatttttgtaaaatcccgtataaatttttggtaaa

SEQ ID NO: 424200 - DNA, 1163 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttccgttgaagccgtccaacggaactttcggcgcagccgcctgctccatcggcttcg

SEQ ID NO: 424201 - DNA, 734 bp, Homo sapiens
ggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcacactaaggacgctgatgttatctgccgtgccagaaatacgccttgacaccttgcagggcgactggagcggagagccagtcatgcacagggatgacccgattctactcagtgtaccaacagacacgtggggagtcaacaacgttgtacctttgaccgcatacgcgcgcatgcatgcacacgagcacacgatcgttaggtcgtcatagattctcgacacatga

SEQ ID NO: 424202 - DNA, 6836 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctccacctgcccgggcggccgctc

SEQ ID NO: 424203 - DNA, 6232 bp, Homo sapiens
aggttattacctgtgcgaagaggtgaatttcgaggaaagagcaatccaagggactagagaaagtgtcatggagaagctgggatttgagctttaaaagacacaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctccacctgcccgggcggccgctc

SEQ ID NO: 424204 - DNA, 7619 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcatttatattctattaaatcctatcctcaactcttgccctgctctccgctccaccccctgccaactactcagtcccacccaacttgtaaaccaataccaaaatactagaggagaagttggcagggatactgttaatacccattttgaatggattgccatctttcagagcttgtctgctctcaactggctctttttctttttgtgtagtttcccttaaataatgaagttagttattaattctttataagtatttaaacataattatataaatatattatatatattatattttttgctgtttactaagctaaaaattattcattgttccacacatgctgctgtgaagttcacattcaagatgaatgttgagactttgaggacagaaaggcaacttattttcccatctttctatggatgcggattggcaggttgaatgggaagtacagaaggagagagagtaattagatggaattctggatgctagcatgtaaagctaatcatctttttttttatgacctgggagctgggcccattttatgaccaaggagatggggagttggaatggtggtactaagaggcataggaagttgagtgtgaataccattggtgatgggtccaggagaactagactatggttcttgaatatctgtccacacaagaatatactaacttttgtcaacttctcagaactcccaactggagtcggtgagacctaggattttctgcacttccacacatgcctgttccaagtgtggctgtcagccagtcaacaagtttgtactatggcccattctctga

SEQ ID NO: 424205 - DNA, 7107 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcatttatattctattaaatcctatcctcaactcttgccctgctctccgctccaccccctgccaactactcagtcccacccacctcgtccacccattgcctgtccctagagtaaaggtcgttcggagcctggggaataacccgggtgggtgtgaagggcattttcactaaggggtaggttcctcctgtgggtggttttatttgagcgtaggttccctcaaagaaagaagtgcgttatgtatgttatataagtattttgaagttataatatagatatataatatagac

SEQ ID NO: 424206 - DNA, 6696 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatctactaaaacgtgtgtgacacggggattctctaaattcggcctgggggcgtgt

SEQ ID NO: 424207 - DNA, 6037 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaaggtccatggttcgccgggccggggggcaatggaccgaagggaggtccccgg

SEQ ID NO: 424208 - DNA, 4988 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccagcggccgccatggtggaggggagggcaggctttttgagtaagagttcccctagtggacgtgggcttagggagagctagacgaggacagcatgagcaaaggtggggaggctgggcgatctgagggtcaatggagaagggcag

SEQ ID NO: 424209 - DNA, 4082 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacgggtatcaccactgtcttgttttgttttctgttaagaatacatgggggcctttgagagctgggagggtggaggtgtgggagctgatgggagaatgattaagtggtcatttgtgtcggagagttgaagtgtatttattataaggtattattattttttcatgtctttgaagaacttgaagaaatactgacatattaaggtactttgttcactgaattctcctctactagatattttaaaatatacttctatcctcgatagtaaaaaaggcacagagccaaaagccctcttgtgatccccttgacttctagaatgtggttattcttatttttgcccgcattcttagacatttactctgaagaagagtccaatggaaataaaggaaaagagtttatgggtcaaggtggcccattgtactgtttttgaagttggtcaacaaggtggcttggttaatttaggctcagcatgttttactgtatgttactaaaaa

SEQ ID NO: 424210 - DNA, 2524 bp, Homo sapiens
ctccataatgtgggcccatccccataatgtgtgcccatctccataatgtgtgcccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcatttatattctattaaatcctatcctcaactcttgccctgctctccgctccaccccctgccaactactcagtcccacccaacttgtaaaccaataccaaaatactagaggagaagttggcagggatactgttaatacccattttgaatggattgccatctttcagagcttgtctgctctcaactggctctttttctttttgtgtagtttcccttaaataatgaagttagttattaattctttataagtatttaaacataattatataaatatattatatatattatattttttgctgtttactaagctaaaaattattcattgttccacacatgctgctgtgaagttcacattcaagatgaatgttgagactttgaggacagaaaggcaacttattttcccatctttctatggatgcggattggcaggttgaatgggaagtacagaaggagagagagtaattagatggaattctggatgctagcatgtaaagctaatcatctttttttttatgacctgggagctgggcccattttatgaccaaggagatggggagttggaatggtggtactaagaggcataggaagttgagtgtgaataccattggtgatgggtccaggagaactagactatggttcttgaatatctgtccacacaagaatatactaacttttgtcaacttctcagaactcccaactggagtcggtgagacctaggattttctgcacttccacacatgcctgttccaagtgtggctgtcagccagtcaacaagtttgtactatggcccattctctga

SEQ ID NO: 424211 - DNA, 2105 bp, Homo sapiens
tacacacaatggggtacacactgcaccaatcccatatccttgttcacatttgtactccacagaattcagctctgaggggggtggtgggcattctccttgcaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcatttatattctattaaatcctatcctcaactcttgccctgctctccgctccaccccctgccaactactcagtcccacccaacttgtaaaccaataccaaaatactagaggagaagttggcagggatactgttaatacccattttgaatggattgccatctttcagagcttgtctgctctcaactggctctttttctttttgtgtagtttcccttaaataatgaagttagttattaattctttataagtatttaaacataattatataaatatattatatatattatattttttgctgtttactaagctaaaaattattcattgttccacacatgctgctgtgaagttcacattcaagatgaatgttgagactttgaggacagaaaggcaacttattttcccatctttctatggatgcggattggcaggttgaatgggaagtacagaaggagagagagtaattagatggaattctggatgctagcatgtaaagctaatcatctttttttttatgacctgggagctgggcccattttatgaccaaggagatggggagttggaatggtggtactaagaggcataggaagttgagtgtgaataccattggtgatgggtccaggagaactagactatggttcttgaatatctgtccacacaagaatatactaacttttgtcaacttctcagaactcccaactggagtcggtgagacctaggattttctgcacttccacacatgcctgttccaagtgtggctgtcagccagtcaacaagtttgtactatggcccattctctga

SEQ ID NO: 424212 - DNA, 331 bp, Homo sapiens
agtggtcacaaaccctttggtttccacagggaggtcacacctggacagatgtatcagtaccaagttctagctgaagctggaggagaactgggagaagcttcgcctcctctgaaccacattcatggagctccttattgtggagatgggaaggtgtcagagtgagtattttggtgtgtgtgtgtgtgtgtgtgtgtgtgtgtgtgagagagagagagagagagagagagagggagagagagagagcaggcactgtgttctctaaacagaagtctcgggagtgtgacttgttgtggatatgtagggagcgaggccacatttgattcttgtgttg

SEQ ID NO: 424213 - DNA, 6184 bp, Homo sapiens
tcggtaacctctctgcctcccatattctccccagagatggcttctccgtcagcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctccacctgcccgggcggccgctc

SEQ ID NO: 424214 - DNA, 7246 bp, Homo sapiens
  misc_feature (6976)..(6976): n is a, c, g, or t
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgagagcagacaagctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactagggcatntagagtatatgaggaggcattatggctgtgcaggagccttcatttcagcttcaattaatagggaagaatttatgatagctctatagatgctgaaaaggtatttcgtaagatttaaaatccatcccttattaacactcttagtaaattaagtctggaaagaaacaccctaatctagataaaggtctgtttcagaaacccacagtgatggcattctaaaagatcagaccgcccaggcattcccattaaagtcaggaaactagccaagggcat

SEQ ID NO: 424215 - DNA, 6535 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagacacatctttcagattcctcagaaccatccagtcctaagctcttctccatggggcctagatgttgtggagccagctcctaaaagcagatttccctcacccccaaaatctggattaggtatttaactcctgttcacatcttgatgctacactgaactatcacatgagct

SEQ ID NO: 424216 - DNA, 4848 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagtgagtattttggtgtgtgtgtgtgtgtgtgtgtgtgtgtgtgtgagagagagagagagagagagagagagggagagagagagagcaggcactgtgttctctaaacagaagtctcgggagtgtgacttgttgtggatatgtagggagcgaggccacatttgattcttgtgttgaaattctaaaatctgggacttggttgtgtcaggtcttgagatctggcatctctacatagttatggaggaacccacttttacttatagctaaccccagagtattgaggtattgaggccgattatctgggggccccttttatggcct

SEQ ID NO: 424217 - DNA, 2117 bp, Homo sapiens
tgggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaaatacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtaacacccttctcctgggctttctgaacctcc

SEQ ID NO: 424218 - DNA, 418 bp, Homo sapiens
gagctgcaaagtcattgctcctccttactggttctcaaccagtcctaagatggttctatttctcttatcccagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcaggtgagttgaaagaacactatcaccaggaccaagttcctgggaaggggaggtattcacactcttctctctggctccacagggaaagagcagatgtttttaaaccatttgaaagcaaaacatgggggctctaacaagcagagagaatgatggcttaatagaaatgcaaggtatat

SEQ ID NO: 424219 - DNA, 5090 bp, Homo sapiens
  misc_feature (1976)..(1976): n is a, c, g, or t
  misc_feature (4040)..(4040): n is a, c, g, or t
  misc_feature (4043)..(4043): n is a, c, g, or t
  misc_feature (4067)..(4067): n is a, c, g, or t
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattggtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagnaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcncantctcagtcacccgtgttatcttcntggctcaaaggacaatgcaaaatcgccgatcagagctcatacccaaagcattacagagaacagcagcatcattgccctccccagctgaaaaacaagttggctagaagatacatggagaggaatggtgttgtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccgtagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaagttt

SEQ ID NO: 424220 - DNA, 5162 bp, Homo sapiens
  misc_feature (345)..(345): n is a, c, g, or t
  misc_feature (2048)..(2048): n is a, c, g, or t
  misc_feature (4112)..(4112): n is a, c, g, or t
  misc_feature (4115)..(4115): n is a, c, g, or t
  misc_feature (4139)..(4139): n is a, c, g, or t
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgatcgaggaaattgccgctctggctgcttctccttngccgccacgctcagacagaggtcgcttctgactagctgtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagnaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcncantctcagtcacccgtgttatcttcntggctcaaaggacaatgcaaaatcgccgatcagagctcatacccaaagcattacagagaacagcagcatcattgccctccccagctgaaaaacaagttggctagaagatacatggagaggaatggtgttgtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccgtagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaagttt

SEQ ID NO: 424221 - DNA, 4046 bp, Homo sapiens
  misc_feature (932)..(932): n is a, c, g, or t
  misc_feature (2996)..(2996): n is a, c, g, or t
  misc_feature (2999)..(2999): n is a, c, g, or t
  misc_feature (3023)..(3023): n is a, c, g, or t
taactctaatagctctattaatgttaggtagaccagtttaatggagtgcattctcctagcagttcattgattataaatacttagcttaagtacctacgtgtgtcctaaaaaaactatttgtccgaatgaaaatcctgattttcaggagcagtgatatgaattctgggcacctgtgcttcagtgaccatgggtggagactttcttgtttatatgtagtcctcttatgttgaaaattacacaaaaacaaaaaagtagtgaataacagtgtcattttttgttttttttgtttgtttgtttctatttcttttgcaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagnaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcncantctcagtcacccgtgttatcttcntggctcaaaggacaatgcaaaatcgccgatcagagctcatacccaaagcattacagagaacagcagcatcattgccctccccagctgaaaaacaagttggctagaagatacatggagaggaatggtgttgtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccgtagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaagttt

SEQ ID NO: 424222 - DNA, 432 bp, Homo sapiens
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattggtaagtaggagtttctctattgatcatctatttattctgctactacatacatataatttaatcttgttgatggattttgcattttaagtcatggcttttcctattatgtttattaaaagcac

SEQ ID NO: 424223 - DNA, 450 bp, Homo sapiens
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgataacacagaaaatacaggcacaagaaagatgagagagcagcacacaaccatttcgcatctttttcgtcgggcagaaccgccgcggtgcgcaggcaaggagtccttcccggcagctccgcgcagctccggttccgcgtcc

SEQ ID NO: 424224 - DNA, 379 bp, Homo sapiens
gcaagcacgaaaagctgagcacctttgggcttatgtgcaaaatggcagatcaaactctcttctccattgtcgagtgggccaggagtagtatcttcttcagagaacttaaggtatgccaccagctattacaacttacagcaccccttttaagagagacctaactatgttcctaattaatacattcttggtgctgaaaatatgtgttccttaattttctactttgtatgatttacagagtagacgtaattttattaccttgacttcaggactgtggcagcttaaatttatggggctttgattttgtgtagctcttagtttgggggggctggcatttaacataaagtataggaaactcgggcttttttttctaaatagtaga

SEQ ID NO: 424225 - DNA, 3137 bp, Homo sapiens
  misc_feature (1838)..(1838): n is a, c, g, or t
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagnaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtc

SEQ ID NO: 424226 - DNA, 2342 bp, Homo sapiens
  misc_feature (345)..(345): n is a, c, g, or t
  misc_feature (1434)..(1434): n is a, c, g, or t
  misc_feature (1466)..(1466): n is a, c, g, or t
  misc_feature (1482)..(1483): n is a, c, g, or t
  misc_feature (1705)..(1705): n is a, c, g, or t
  misc_feature (1778)..(1778): n is a, c, g, or t
  misc_feature (1783)..(1784): n is a, c, g, or t
  misc_feature (1849)..(1849): n is a, c, g, or t
  misc_feature (1859)..(1859): n is a, c, g, or t
  misc_feature (1903)..(1903): n is a, c, g, or t
  misc_feature (1920)..(1920): n is a, c, g, or t
  misc_feature (1925)..(1925): n is a, c, g, or t
  misc_feature (2109)..(2109): n is a, c, g, or t
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgatcgaggaaattgccgctctggctgcttctccttngccgccacgctcagacagaggtcgcttctgactagctgtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaagggtctnactctgtcgcccagtctggagtgcagtggccnatcttggctcatggcnncctccacctcctgcattcaagtgattcgcctgcctcagcctcccgagtagctgggattacaggcgtgcaccacaacacccatctaatttttgtatttttagtagagatgggattttgccatgttggccaggctggtctcaaaactcctgacctcagggtgatctgcctgcctcggcctcccaaagtgctgggattatgggcatgagccactgcgcctggccntaattgtgcttttttttccttttttctttttttgagatggagttacactcttgttgcctgggctggggtgcantggcnnagtctcggctcactgcaacctcacctctgggttccagcaattctcctgcctcagcctcccgagtngctgggattncaggcatgcgccaccatgcctagctaattttcgtattattagtngaaacaaggtttcaccntgtcngccaggctggtctcaaactcctgacctcagatgatccacccgccttggcctcccaaagtgctgggattacagatgtgagccaccacgctcagccaaattgtactttcagtaaagtactttactgtttacaaagaacttccatatacatttttttggtcctggtctctgtctttcattttgggancatggatgtaactggcctttcatcaatggttcagtagtgttgttttttaaagcctacaacagaaccatctcctatgaattgactatcacctgtctaaatgccctgttacagcatgttgtactgcaagagcaggatatttaaagtactttataattgataattgccattatcaatatgctcacctctttaccatattccaacaggtcttaaaggacttgtattattttttaccg

SEQ ID NO: 424227 - DNA, 2239 bp, Homo sapiens
ggggggcccacattttttgtttaggataaaactagcctgagcactgttctactgaatctgaagtcaggagtatcagatttttgtgtcagtccagcccttagccagtgctaaatgactttgaatgtgttagctagtcttttgggtataatgtccacatctgagggatttgtcccttatctgaaaagtagataggtggtgagttcttcagggacaaggattcaattttattcatacagtatatatgtggatatacatatacacatttatacataaaatcccagtacctagcactgtacctggtccttggtaaggccttgataaaggtttgttagaggcgtgaatattttctgtcttcagggcactttatattctttatgaaaagcagtttatgtagtttatgttattgttttaaaaaacttaatcctaaatgtgaagtcatttcttttctttgttttgttttgttttgtttttgagacggagtctctcattatcacccagattggagtgcagtggcaccatctcggctcactgcaacctccatctcccggtttcaagagattatcatgcctcagcctccaagtagctgggactacaggtgtgcaccaccacacccagctaatttttttttttagttgagatgggagtttcaccatgttggccaggctggtctctaactcctgacctcaagtgatccgcctgcctcagcctcccaaagtgctgggattacaggtgtgagccaccatgcctggccaatagtttatttccaatgcatctattaatttgattcttttctatttgacaaccctttccaatattctctttgcatccaaatggaatttatgttttttcccaagttcccaactgcccaaggtagacactggcagatttatatcaaggttctttgacatcttgaacttcagatcagaggatggagttcttctctcattgccttgagcaagggcttataaccagagccacattaagaactcagatcatgctccctaattgaggacacatagcaagcttcaccaagccctccactacaactataccaatttgtcttcctgtagacttacaaggtaccactagggttcctttggagaactcaggagtccagtataacttggagtgataataccacattggaactcacaactcttctaactccagggatttgaatgtgatttcttctttttaattcagagtagcgtaatgatcctacacttgggcatatttgtcttggccccactcccaaagcaaatagatttccatgtaactggaaatctgctgcaaaccccaagaattttatcctccctcaaaaagtgctatcctgagtggttttttttttctttttactgtacattgaaaattgaagttgttgtttcctttttttttaatttgagacaaggtctcactgtgtcacccaggcatgatcacagctcactgcagcctcaatctccccaggctcagatgatcctcctgccttagacttctgactagctgagactacaggcgcaatgccaccatgcctggctaatgtgtgtattttttgtagagatggagtttcgtcatgttgcctaggctggcctcaaactcctggcctcaagcgatcctcccacctcggcctcccaaagtgttgggattacaggcatgagtcaccatgcccaggctaaagctgttatttcctcataacctttactgcacatgttttaaaacaggtccttatcattgtttgccccagcaactggaatagctttctatctgctttcaatcttaacccagtctcaccagggcatataatctttctagaatgcaaatctgatcattttacttgaaggcttaagttttgcagtgacatactttagagcagcactgtctgataggaatagaatgttagcttcatgtatacagatgctccttgacttaggatgggtttatgtcccaataaatccaccataagttgaaaatattgtaagtaaaaaatgcatgaaatacacataccctactgaatatcatagcttagccaagcctaccttaaatgtgctcagaacactgatgttaacctacagttgggaaaaatcatcttacacaaaccctattttataataaagtgtgaatatctcgtgtaatttattactattgatcataaagtttaagcattataagttggcgatagtctgtaattgttaatttgtttgtatccaatataaaaaatataaagagaaacagatgaaattaa

SEQ ID NO: 424228 - DNA, 2248 bp, Homo sapiens
gccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaa

SEQ ID NO: 424229 - DNA, 1487 bp, Homo sapiens
tgcagtggaatgatcatagctcacttcaacctcaaactcctgggctcaagcggtcctcccacctcagcttcccaagggagctgacactacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaa

SEQ ID NO: 424230 - DNA, 5978 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424231 - DNA, 1798 bp, Homo sapiens
tgagcaaggactccccagagaagagctgtaaatatagttaagtgggttgagaaaagaacaaaagaagaaagggaaatggttctttttcttttgcatagtttgcatgggagacagtgccagaggaagaaaagagcagcataatgccactgggatggactcaaacttcagaggaaggttctttcctccaaggaacccctgtttcacttagctttatggagggctgaaactcattagactgtgttccctgagcctctgcccctacatcttatagattgcctagccattgaactaagaggcaaaaaccactttggtttttttgaaaggttatttgaattttaccagcattatttaatttcatgtagatagtagagagagaagtaagatactggaaaattactgttacataagttgggagagtatcactatctagaagctacagataataagaaagtggcccctagttttgcctgtttcttgtttttaattgttaagtatcatgcatactttttagttccacatttttaatccttttgcattgaaaagcattcttgccttgtgcttaccctttttattgaaacttttcctaattgactgtaaattgctaatttaatttcctttaccaggtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaagtaagttaattttccactgatcttttattaaatctttaacattccgtcatatcttatgtctttgttttccagagtcaggctttttgagttttaaattccatctctgccacttactgtgtgacatttggggagttattttttctgtttctgtctttgcacattttaaaaatgagaattctatctaaaaagttgtgaaaattgggccagggagatatctggcttatgtctataatcctgacactttgggaggtcaaggtgggaggatcgcttgagcccaagagttcacgaccagcctgggaaacaaagtgagaccttgtctccacaaaaaatttaaaaattagccagtcatatacctatagtcccagccacttgggaggctcagacaggaagattacctgagcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatgagagaatgcttcattatctttggaggttgggagatatgagggaccaggaagctttcctggaagagcttacattatgacccaatatacattatgacccaacataacacatgtatacacctatgtgcaatgtgtttatacatttatcaatttgtatgtttttactggtttgtgatataaaatggacatgtatatgaaataaaacagaacttagcatcagtatgcatagttctctgtaatattttctagtttcttatactgtgtttcattaaacaaaacaaaacttttaaaaattgaaaaaagaa

SEQ ID NO: 424232 - DNA, 459 bp, Homo sapiens
aagggatgtgacaagaatgttaacagtttaacagttagtgggtttagataagcaatgtttaggtgttcattataatgttataccaacttctctgtgggattttaagagataaacgagtaatataagaaacattctaagtatttgaataaaaaagtgaagcctgcctttctttgtaagtctagagcaatactaattcatctttttttttagttttgtttagattttatcaagatacagctagacggtaagctattttatgtctttttacttaccaaagctttctttacaccaaagcactttacaggaataaaagattaaataatattcatagaatttattaagatggttagttgttacatatatcttcttatcaaagggcatatatcttggtgtaatttcattcagaaatatcacagaacctaactttttagaaaccccttttcatttggaaaaaataaa

SEQ ID NO: 424233 - DNA, 5957 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424234 - DNA, 5903 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaagtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424235 - DNA, 3945 bp, Homo sapiens
  misc_feature (1)..(1): n is a, c, g, or t
  misc_feature (10)..(12): n is a, c, g, or t
  misc_feature (38)..(38): n is a, c, g, or t
nggggatccnnngactcttccggatcccccgcaaattnccttccctcgagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424236 - DNA, 4117 bp, Homo sapiens
tgagcaaggactccccagagaagagctgtaaatatagttaagtgggttgagaaaagaacaaaagaagaaagggaaatggttctttttcttttgcatagtttgcatgggagacagtgccagaggaagaaaagagcagcataatgccactgggatggactcaaacttcagaggaaggttctttcctccaaggaacccctgtttcacttagctttatggagggctgaaactcattagactgtgttccctgagcctctgcccctacatcttatagattgcctagccattgaactaagaggcaaaaaccactttggtttttttgaaaggttatttgaattttaccagcattatttaatttcatgtagatagtagagagagaagtaagatactggaaaattactgttacataagttgggagagtatcactatctagaagctacagataataagaaagtggcccctagttttgcctgtttcttgtttttaattgttaagtatcatgcatactttttagttccacatttttaatccttttgcattgaaaagcattcttgccttgtgcttaccctttttattgaaacttttcctaattgactgtaaattgctaatttaatttcctttaccaggtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424237 - DNA, 4175 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccagaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424238 - DNA, 1059 bp, Homo sapiens
cactaaggcagattttgtgttcttgactactgtatcattaattaactactagcattaatttcagcctcatatactatgagtgatagacatggccttttttattatgtaatgtttcttattgatacaatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424239 - DNA, 3767 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagagtgcttcacttctgtctgggcaacagctccgttcatcattaccactttatgtgccttcaccgatgagatgttgatttgaagttttatttgaaggagagctttgaactgtgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaagtaagttaattttccactgatcttttattaaatctttaacattccgtcatatcttatgtctttgttttccagagtcaggctttttgagttttaaattccatctctgccacttactgtgtgacatttggggagttattttttctgtttctgtctttgcacattttaaaaatgagaattctatctaaaaagttgtgaaaattgggccagggagatatctggcttatgtctataatcctgacactttgggaggtcaaggtgggaggatcgcttgagcccaagagttcacgaccagcctgggaaacaaagtgagaccttgtctccacaaaaaatttaaaaattagccagtcatatacctatagtcccagccacttgggaggctcagacaggaagattacctgagcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatgagagaatgcttcattatctttggaggttgggagatatgagggaccaggaagctttcctggaagagcttacattatgacccaatatacattatgacccaacataacacatgtatacacctatgtgcaatgtgtttatacatttatcaatttgtatgtttttactggtttgtgatataaaatggacatgtatatgaaataaaacagaacttagcatcagtatgcatagttctctgtaatattttctagtttcttatactgtgtttcattaaacaaaacaaaacttttaaaaattgaaaaaagaa

SEQ ID NO: 424240 - DNA, 3355 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagcgtgagtaagaatttcctttaaaggaaaatctttaaatcatgtaaatgatggcaatttttaaataatgagtatgaggtgaagaattcattttaaaacatctttctgaaatctcttgtgtatattcatatttgtactgcctgttttacaagaattaatgcagtttcacagtgaagcatgtaagatattgaattttagagacaatagaccagatacctttctaatctcattttattcattaatgtcaaataataccatttttaaaaatatggtgcttattgtctagcaagtaacctatagaaaagtattattttatacaaaaagatgattaggtcacataaaggaattggaatcttaagtttaaaatacacttctgtttttagccagaaaggagaaacgatggttggatttatgccatttttcaattaaaaaccatgtggactacttgaagcagt

SEQ ID NO: 424241 - DNA, 1339 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggtaagaattctaattgtctttggttagtatatacatggcatcttcttcaataggttttcactttttttaaccatttttttcctttgtgaaaccttactgttttcactgtctgtagagagatatatctctgaaataattcatgacatgaaattatactattttatatctgcttttgagtaatcagattctgtaaatagagaatttttcactaagacctgttgtattgcattataatccagagaatc

SEQ ID NO: 424242 - DNA, 234 bp, Homo sapiens
gagaagagtaatccaggatataattattggtttagtcttatgttctgattatttttttgctgaaacactagcttattttaactaaaacttaaagtttatttttttctccttcctttagaacgtataatgaagaaaacagaagagtccgaatcacaagtggagcctgaaattaagaggaaagtacaacagaaacggcactgtagtacctatcagcctactcctcctctatctcct

SEQ ID NO: 424243 - DNA, 886 bp, Homo sapiens
ttagtgaaaagctgttttgcagttagattctcttgagatactaccagttcacatggcaattttctatttgtgtttgacaaaaatgttaactattatatctttaagactatagatttagatttattagatgaagtaaattagttacatacgtgaatagatttgttcttgaactgttgttagagtaatgtattctggttccttccaataacttaggtgacattggcatgtaacacatactggtctttccagtgattgttgtgtatccactgtatgtcagacattgttgtggacctttatactgggatttctgattatcctcctggaaagaattaataattactccttttaaaagtatctatttacttcttttgtgtttttttttggacttatatttatttcttttcagatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtaattatgttttttaatttaaaaatattcttaaattgtgggtagttttaaagggaaatatgttttattttaatactgttcatttcagtgttaaatctttttaattttatttcagaattacttacttttatgtgtgatttgtaaactaccttgtgtcaaaacagtggtgggtaggtgccaaataccacttgatacaggtctcagaagcatttttggttcctccacattctatccttatctttacttttcatca

SEQ ID NO: 424244 - DNA, 4285 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424245 - DNA, 6086 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagagtgcttcacttctgtctgggcaacagctccgttcatcattaccactttatgtgccttcaccgatgagatgttgatttgaagttttatttgaaggagagctttgaactgtgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccag

SEQ ID NO: 424246 - DNA, 3836 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagcatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424247 - DNA, 1524 bp, Homo sapiens
tgctgggattactggcgtgagctactgcgcccggccagaattaggcatttttaataaattaattggcaagaactttagaaaaaaacattttaattgatatgtattgccaaatataataaacttttctaataacatatttagtcatttcatttgttttttacagtgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424248 - DNA, 978 bp, Homo sapiens
atcccccgggctgcaggattcggcacgaggttccacacatcatacatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424249 - DNA, 902 bp, Homo sapiens
tgaagaatcgagtcggtccctcgcgaacgtgtatctgatcttcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatagga

SEQ ID NO: 424250 - DNA, 2210 bp, Homo sapiens
ggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattgtaagtacatcttaagctctttactataccaattataacattaaaaattccgttgctaaagctaatatataatatttaaaatttataagttaaaatatttaatagaatatcagttagttcaagatttcacattgctttaagagtatataaatagtagctccttgccattaaaatgagttagaaaaccttccaatatgttattg

SEQ ID NO: 424251 - DNA, 4320 bp, Homo sapiens
tcaggtgatctgtttttccttggccatctctccgtctgctcaccactcttttttccctagtacacgaatatctttaacattcaaaaatatatcttaacacttaggatagatcaaaattggtgttcattcagataacattgtcagattctcttagatccaaatatttcttttaacaacttaacagtatgttaaaacctcattcacttgcttggagagctgttgtacagttctttaaagagttctttatatgaggttgaatcttccctttcttaatagtcaaattctatatatggtgtcttcctttggaacaccttaccatgggctatttggtcagctccattgactccttgccttgggaattttagtgcagtgagagttgtgctcacttctccttcacttcagggcctgatgtgtcaggaaatggagttttctgaattaacatgaaagttgagttgcagattgcttggttaaaaaacaacaggtggggcacagagtctcatacctatgattgcagcacttcgggaggtgggaggattgcttgaggtcaggagtttgagaccgacctggccaacatagtgagacccccatctctattattttgaaaaacaacagcaaattttttcttaacatccaagacaaggccaccagtcaaaactatcaagttttagtagtattttcctgcttgattatataatagcctggcttagagatacaacctttaaataaggaatcttaagatgatgtgcagctgttctttgccttatttgtttgtttgttggttagtttgtagtttctaagaatctgctctgttcagctgtacagttccttcttctggagttaacctgtggcaaggattatgtttcacctgtcacaaaaatgagatctgtgccttcctctattataaagttagggcatgtgattcattcttcgaaatacttcaaaatgtactttggtatgtttttgtcttgaaaagaggttttctagctagaaattcggggcccagaaggtcaaggctccagagatccccttctcatcatccttcagttgtctgaggagacagaggatcacatgtgtcacagtgagtgctgattccccagaatctgcagtcttaagctcccctgctgacgcacacagccagttctctgcttcatattcatgtgacccactgtgaagtgacaggcagctgccaattctgtcatataagaagcagctctgcccatgcaactttgaaagttcctgcacttctccatagactgctccttcatggaaataaacacatcatcacactgtgggtgcctaagctaagtttgtttgcagtttgatgatgcccagctccttttcaactcagccttaattggcactttaagggccaggatgaggtttctctcaggccaagtcgagatttccagatttccttttgtccaaggctgaccagtttagaagttattcacatccttgttttagttctttccttcttgtcctggtacctcttcctttccaggattatttgcagagtctgtgatggcttacttggtgaccagacatggggtgagctactggtatagtctgattactttggcatctattctgaactggtcattggctgtacatgagtttttgtgctggtaaaggaatatactgggaagattggaaggcacagactgggaactaattctgagaagagaactgctgagttactgaaagaccttttggaccacccctaaatggagcatcttgatagatggcaaatccagtgtttcttaaacttgtccatgctgcccagagcccactgccttttatcagatgtgagacttcactgccacagtgtcatcccacagtttccttccctggacatttgataaagggaaaatcatttcttgtcctttaaggcagggactattattttttcacttttccacataccccacaacacctaacattgatttactcgtagtaggagtttcatactgttgaactctctaaaggccatttgttccagggcctagctgggcttgtgaaggacaacagagtcatttcctaaggaccccaaaagacagcatgaaggaaaaaataataataaactgctgttcacagtgccttgagtgtaccaccgtactttctgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaaatgtcagttcctgtcactcttccaccccttttctccctctcccctgcattgtggtctgggccttggtccactagcaactccccttaggtgttgcttaatctgcctcatggccaaagccaatcccattcctgtcccccgctacccaagggactcccagtctgtatgcacaaggcgggatgtgaagtctggatgtgcaagaaacccagctgtaagaaacagcttccctcggcttggcatggtggctcatgcctataatcccagcactttgagaggtcaaagtgggagaatcacttgagcccaggagttcgggactagcctgggcaacatagcaagatcccacctctacaaaaaaagaaaaaattcagagtctcaaatgtcccttcatctccttactctcgacctgtctccctagttctctgccgccttttcctctcccctggatctgacactcaattgtctgcatgcacttttcaactgaaagagactccaatgccatccttctgatgaaatttttgctttggatactactgcagaaaaaatgctatcttgtattctggtccatggtggggaagaccctgtcgtagaacctggcaactcaagtggagggaggggccagaacattgttcttatgctatttacagtgagacaacaggattgatgcagaactttctttttttttttttttttttgagacagagtttcattcttgttgcccagggctggagtgcagtggcatgatctcagctcactgcaacctccaccccccaggttcaagcagttcttcctcagcctccggagtagctgggattacaggcgtgcgccaccacgcccagctaatttttgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacacctcttggaggcagagcccctcagccctatccaggccagcagtgtccacttgaaatctgaaagcagcctccctcaccaaaccagcaagatggaaaacctccctgggttggcaagtggccctgggaagtacatgccccatctctgtcaggatagcagtggagaggtttcgtgccagtgccagctccacccacccagatggtactcaagactccaagcctgtcaatggggtggaaactttctggcattttctgtcagaagggtgagttagcactgaaccatctcatgtgtcttttcactgagtaacagcccatatccattccatgaaatgagtgactgctttgttgaatcagatagtaacaaacatttatttgtagtctggttgtgtcatatcatggttgaattgcaaacaggttggatagaagagtcagcaaaaatcaacaaaagcattctgtaaaaaacttttctagaattacaataaatggcattgtatattttatttataaattatgtgctgcacatcatttttatcaatgaaatttataataaatttctgtacatatatacatttttat

SEQ ID NO: 424252 - DNA, 3818 bp, Homo sapiens
tcaggtgatctgtttttccttggccatctctccgtctgctcaccactcttttttccctagtacacgaatatctttaacattcaaaaatatatcttaacacttaggatagatcaaaattggtgttcattcagataacattgtcagattctcttagatccaaatatttcttttaacaacttaacagtatgttaaaacctcattcacttgcttggagagctgttgtacagttctttaaagagttctttatatgaggttgaatcttccctttcttaatagtcaaattctatatatggtgtcttcctttggaacaccttaccatgggctatttggtcagctccattgactccttgccttgggaattttagtgcagtgagagttgtgctcacttctccttcacttcagggcctgatgtgtcaggaaatggagttttctgaattaacatgaaagttgagttgcagattgcttggttaaaaaacaacaggtggggcacagagtctcatacctatgattgcagcacttcgggaggtgggaggattgcttgaggtcaggagtttgagaccgacctggccaacatagtgagacccccatctctattattttgaaaaacaacagcaaattttttcttaacatccaagacaaggccaccagtcaaaactatcaagttttagtagtattttcctgcttgattatataatagcctggcttagagatacaacctttaaataaggaatcttaagatgatgtgcagctgttctttgccttatttgtttgtttgttggttagtttgtagtttctaagaatctgctctgttcagctgtacagttccttcttctggagttaacctgtggcaaggattatgtttcacctgtcacaaaaatgagatctgtgccttcctctattataaagttagggcatgtgattcattcttcgaaatacttcaaaatgtactttggtatgtttttgtcttgaaaagaggttttctagctagaaattcggggcccagaaggtcaaggctccagagatccccttctcatcatccttcagttgtctgaggagacagaggatcacatgtgtcacagtgagtgctgattccccagaatctgcagtcttaagctcccctgctgacgcacacagccagttctctgcttcatattcatgtgacccacttaattctgagaagagaactgctgagttactgaaagaccttttggaccacccctaaatggagcatcttgatagatggcaaatccagtgtttcttaaacttgtccatgctgcccagagcccactgccttttatcagatgtgagacttcactgccacagtgtcatcccacagtttccttccctggacatttgataaagggaaaatcatttcttgtcctttaaggcagggactattattttttcacttttccacataccccacaacacctaacattgatttactcgtagtaggagtttcatactgttgaactctctaaaggccatttgttccagggcctagctgggcttgtgaaggacaacagagtcatttcctaaggaccccaaaagacagcatgaaggaaaaaataataataaactgctgttcacagtgccttgagtgtaccaccgtactttctgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaaatgtcagttcctgtcactcttccaccccttttctccctctcccctgcattgtggtctgggccttggtccactagcaactccccttaggtgttgcttaatctgcctcatggccaaagccaatcccattcctgtcccccgctacccaagggactcccagtctgtatgcacaaggcgggatgtgaagtctggatgtgcaagaaacccagctgtaagaaacagcttccctcggcttggcatggtggctcatgcctataatcccagcactttgagaggtcaaagtgggagaatcacttgagcccaggagttcgggactagcctgggcaacatagcaagatcccacctctacaaaaaaagaaaaaattcagagtctcaaatgtcccttcatctccttactctcgacctgtctccctagttctctgccgccttttcctctcccctggatctgacactcaattgtctgcatgcacttttcaactgaaagagactccaatgccatccttctgatgaaatttttgctttggatactactgcagaaaaaatgctatcttgtattctggtccatggtggggaagaccctgtcgtagaacctggcaactcaagtggagggaggggccagaacattgttcttatgctatttacagtgagacaacaggattgatgcagaactttctttttttttttttttttttgagacagagtttcattcttgttgcccagggctggagtgcagtggcatgatctcagctcactgcaacctccaccccccaggttcaagcagttcttcctcagcctccggagtagctgggattacaggcgtgcgccaccacgcccagctaatttttgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacacctcttggaggcagagcccctcagccctatccaggccagcagtgtccacttgaaatctgaaagcagcctccctcaccaaaccagcaagatggaaaacctccctgggttggcaagtggccctgggaagtacatgccccatctctgtcaggatagcagtggagaggtttcgtgccagtgccagctccacccacccagatggtactcaagactccaagcctgtcaatggggtggaaactttctggcattttctgtcagaagggtgagttagcactgaaccatctcatgtgtcttttcactgagtaacagcccatatccattccatgaaatgagtgactgctttgttgaatcagatagtaacaaacatttatttgtagtctggttgtgtcatatcatggttgaattgcaaacaggttggatagaagagtcagcaaaaatcaacaaaagcattctgtaaaaaacttttctagaattacaataaatggcattgtatattttatttataaattatgtgctgcacatcatttttatcaatgaaatttataataaatttctgtacatatatacatttttat

SEQ ID NO: 424253 - DNA, 532 bp, Homo sapiens
tgagacggagtcttgctctgtcatccaggctggagtgcagtggcatgatctctgctcactgcaacctccgcctcccaagttcaagtgattctcttgcctcagtctcccgagtagctgggattataggcatccaccatcatgcccagctaatttttgtatttttagtagagatggggtttcatcatgttggccaggctggtcttgaactcctgacctcaggtgatctgcccacctcagcctcccaaagtgctgggattacaggcgtgagccactgtgcccggcctatccttaactttagacattgcacacagtacaactgctatccgtatcggatagttcttaaggtcagcagctattgcttattgtgtctgctgactctcttggtagctgcccttcttttgtgtctagtgatctttgagttcattgtttgatcttaaccaggggaactgtatgggccaaaattaggattgaggatatttttctccatagaggattttccttaacttttgcagcagctgaaagatgccattca

SEQ ID NO: 424254 - DNA, 2949 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424255 - DNA, 2712 bp, Homo sapiens
atggcttgggtaccacaacttccggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424256 - DNA, 3014 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcaggattgacataacttccctctggtcagatatcgaagtcagtgggaaataatatttgttgcaaaaaaaagggggggcaaaaatctcgaggcaattaggacagttttgtaaggccaagggggtaaaaagagggggtacggcgaagagggcggggactgggga

SEQ ID NO: 424257 - DNA, 2830 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424258 - DNA, 2720 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggtgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424259 - DNA, 2079 bp, Homo sapiens
agcttcagtcacgaaagaggctctgagcacggtggggagggaaggccagacctcagggcagagcttcccaacctgcaggccctgtcttaatccccttagacttgggagtggccttctccaatcactccagcctgctgtgatgtgaaaagagctgggaaccattgacttaagggcatgcagaggggagagactggatgaggggaatgacagtcagaggcaggtgttgaggtggatgcaggagtagcaacagcaggtgggtgtaggccctttttgtacccctatgttcccccaccttttcagtgcccattcagcttgctcttagacagcccggacctagatagatgcgaagggtctgcctagctcttattactcaggtttactgattttccagccatatccatgggaagtcagtgttggggtccatcccttctgtttttcttctttactcctcctctcccagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424260 - DNA, 1894 bp, Homo sapiens
gttctagaggatcccgaaaagcgacatagaggcaggtgttgaggtggatgcaggagtagcaacagcaggtgggtgtaggccctttttgtacccctatgttcccccaccttttcagtgcccattcagcttgctcttagacagcccggacctagatagatgcgaagggtctgcctagctcttattactcaggtttactgattttccagccatatccatgggaagtcagtgttggggtccatcccttctgtttttcttctttactcctcctctcccagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424261 - DNA, 2363 bp, Homo sapiens
agcttcagtcacgaaagaggctctgagcacggtggggagggaaggccagacctcagggcagagcttcccaacctgcaggccctgtcttaatccccttagacttgggagtggccttctccaatcactccagcctgctgtgatgtgaaaagagctgggaaccattgacttaagggcatgcagaggggagagactggatgaggggaatgacagtcagaggcaggtgttgaggtggatgcaggagtagcaacagcaggtgggtgtaggccctttttgtacccctatgttcccccaccttttcagtgcccattcagcttgctcttagacagcccggacctagatagatgcgaagggtctgcctagctcttattactcaggtttactgattttccagccatatccatgggaagtcagtgttggggtccatcccttctgtttttcttctttactcctcctctcccagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtcactgaattctggtccttgatgcccaacaggccacgaactctcttggtcttgcatgactctgccctgaccttagactcctactgacctggtatcatcaacctttattcccattcatttgctccggaggcagtagtgctgctttttgactcacctttctccaaccactgccccccaacccccacaactagctattgaccattaaactgaatgatgccccactccctcccatccccctccaacattccttgctggctgacctctgattctgattaagcccacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424262 - DNA, 2733 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggactttctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424263 - DNA, 1665 bp, Homo sapiens
gttaaacctgacagtctgttcactgaacaggtccttagtttcctgtctgcctttattttcagtctctgcttatcagaatctcttggtcttgcatgactctgccctgaccttagactcctactgacctggtatcatcaacctttattcccattcatttgctccggaggcagtagtgctgctttttgactcacctttctccaaccactgccccccaacccccacaactagctattgaccattaaactgaatgatgccccactccctcccatccccctccaacattccttgctggctgacctctgattctgattaagcccacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424264 - DNA, 1358 bp, Homo sapiens
atggtgagtggtgcactgtgggtaggagggactgaaggtagagtcacatcacatggaggtgggttggctaaggaagttgggaggttgtgttggttgggccaggaggtgggtgtgattttccttcccactctctcctagatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424265 - DNA, 1580 bp, Homo sapiens
atggtgagtggtgcactgtgggtaggagggactgaaggtagagtcacatcacatggaggtgggttggctaaggaagttgggaggttgtgttggttgggccaggaggtgggtgtgattttccttcccactctctcctagatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggtaataggtgctccttctccttgccttcctacccagaaaattcggtttcccccactgctgttagctctgtgagggcagagatgatgcctgtcttgttcagtgttttactcttggagtctggcacagtgtccagcttagtacaataagtgtggaatgaaggggacatcctgaagtgaaggactgctttccccaaactagacatttccctttgtcttcccttaggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424266 - DNA, 1869 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctggtaagactcctgtttcctgtaccattcaacacctttgtccccagtcttcatcagcagcatagtggggtcatgactctggtagaactgaaatcaggatcgcctcattctaaaatgtctaagccttggctgggcgtggtagtgcacacccataatcccagcactttgggagtccaaggcagtaggattgcctgagctcaggagtttgagaccagcctgggcaacaacctcatctctacaaaaaatgaaaaattagccgggtgtgtgttgatgtgtgcctgtggtcacagctactaaagatgctgaggtggaaggattgcttgagcccaggaggtcaaggctgcagtgagccatgcactccagagtgagacctgtctcaaaaaaaa

SEQ ID NO: 424267 - DNA, 1427 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaagatatcctagtactggggaaccctcatgccaggccttgagagtgggaggactttcgactccagccacccatgcactgctccttaccttttcctatgggactgaaaccttttagaatgtgatgaaagctatagcctccctccccagaaagatgcacacattattttgacacatagttttgcatatgattgcaagggagggagagacaccctgaagcccattcacagatgtcag

SEQ ID NO: 424268 - DNA, 999 bp, Homo sapiens
agcttcagtcacgaaagaggctctgagcacggtggggagggaaggccagacctcagggcagagcttcccaacctgcaggccctgtcttaatccccttagacttgggagtggccttctccaatcactccagcctgctgtgatgtgaaaagagctgggaaccattgacttaagggcatgcagaggggagagactggatgaggggaatgacagtcagaggcaggtgttgaggtggatgcaggagtagcaacagcaggtgggtgtaggccctttttgtacccctatgttcccccaccttttcagtgcccattcagcttgctcttagacagcccggacctagatagatgcgaagggtctgcctagctcttattactcaggtttactgattttccagccatatccatgggaagtcagtgttggggtccatcccttctgtttttcttctttactcctcctctcccagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctggtaagactcctgtttcctgtaccattcaacacctttgtccccagtcttcatcagcagcatagtggggtcatgactctggtagaactgaaatcaggatcgcctcattctaaaatgtctaagccttggctgggcgtggtagtgcacacccataatcccagcactttgggagtccaaggcagtaggattgcctgagctcaggagtttgagaccagcctgggcaacaacctcatctctacaaaaaatgaaaaattagccgggtgtgtgttgatgtgtgcctgtggtcacagctactaaagatgctgaggtggaaggattgcttgagcccaggaggtcaaggctgcagtgagccatgcactccagagtgagacctgtctcaaaaaaaa

SEQ ID NO: 424269 - DNA, 665 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424270 - DNA, 340 bp, Homo sapiens
tccatagaggattttccttaacttttgcagcagctgaaagatgccattcagatggatctacattagtcatgatgccagaattgggcaaatctgctgacaccaggacacctgtgtatatgtgtttgtgtctttccaggaattcattgaagagttgctgtctcccccttttgggggtttagtggcatttgtgaaggaggctgaggctttgattgagcgtggacaggctgagcgacttcgaggggaagaaggtatgaggaaaatatggtaatgatgggatcagtggtaagggaagtggaaaagaaaaatgaaaggatgcagattacatggtgggggaatagag

SEQ ID NO: 424271 - DNA, 2520 bp, Homo sapiens
atggcttgggtaccacaacttccggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424272 - DNA, 3233 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtcactgaattctggtccttgatgcccaacaggccacgaactctcttggtcttgcatgactctgccctgaccttagactcctactgacctggtatcatcaacctttattcccattcatttgctccggaggcagtagtgctgctttttgactcacctttctccaaccactgccccccaacccccacaactagctattgaccattaaactgaatgatgccccactccctcccatccccctccaacattccttgctggctgacctctgattctgattaagcccacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424273 - DNA, 2844 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424274 - DNA, 3480 bp, Homo sapiens
ggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcaggtgacctgcaagtcccaggccccactcagatcccccatcattaattattttccccatctttttgctgggctcagcatcatctaagtgacccttggtcttcagttactagctgtgcccaaagttctgtatgagccctaacctgattctttttttgtttgtttgttttgttttttttttgagacagagtctagctctgttgtccaggctggagtgcagtggcacagtctcggctcactgcaacctctgcctcccaggttcaagtgattttcctgcctcagcctcccaagtagctgggattacaggtgcctgccaccacaaccagctaattttcgtatttgtagtagagatggggtttcactgtgttggccaggctggtctcgaattcctgacctcgtgatctgcccgccatggcctcccacagtgctgggattacaagtgtgagccactgcgcctggccgcctaacctgattcttaatcatcactattagcaccattttacggtttgatccctcaatgactttctttgaccagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaattaaaa

SEQ ID NO: 424275 - DNA, 2123 bp, Homo sapiens
  misc_feature (2123)..(2123): n is a, c, g, or t
gagtctgcctctggcctgcccctcaccagaggggtgtctctctgtcagcaaggccagtacctggggacccaggtccccacgtgggaccagctcccagatctgggcttcaggcctccgtaggccaggtcagtgacacctcctggctgggttgaaagagcaggtgcattaacaccacacatggccaggaacacgtgcctctgacgcacagggctgctgccctgccgtgctgccaggacagtagaaaccaccgcctatagggaccctttcacactcagacccttgaccacgtgttgcggagccttttgctggggactgggagggagatgactcctgcactctgcttgcccgcaggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctgccttgcaccaggctggactctgaggggacccctcaccctggcctttcctgcactcattggcactgagacgagagaccctggatgtagctggggcactgcttaggcctcagccagtggtgccaccctctctctgtgtcagaatcgagcaggcaaccctagtccaccctcaggacctgggcacaggtgtgcagtgctccctctggagctgagtgagcaagaggatgcagcagtcgggggacccacccggtgagcgggcacccccagtcagcgtccaccaccgtcctccatcctcatcctcgtcctcattactggaggagggagcgcatgtccaggcaggcaggacagagcaccgagccagaccaggaatcagcgggagtgaggcatctgcccacattcaccgtgtgctctgcagaaagctccctcaggcctcagtctgcacccaggctgccccgggagtgagaccccatccctgccctcctgctgccgccagagtagctgacagggtggttccatgtggcccagtgacatgagggtcatgtggcattaccagtaacaagctggcagcaaagcaaaggggggatggagtcagctgaaacccactgggatggtgccagcgaggggccttgaaagttgaggaggtttcaggtaagcagaaaacaggggtaatggcagccaggagccgaaacatgagcaaggctgtccccaagagcaaggccaagaagagttccttctgctgggacgagggatccaggagcttgaggcattgggagcaggcagcagagggcaggtgggcacagtgggcgtgcctttacagggctcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424276 - DNA, 3211 bp, Homo sapiens
  misc_feature (3211)..(3211): n is a, c, g, or t
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424277 - DNA, 2931 bp, Homo sapiens
  misc_feature (2931)..(2931): n is a, c, g, or t
gactctaactatagctgggtctatatgtagctgaggatataggtgtggtgaatccggcttcgagtggttgccgccccgggaacaaggaccggagctggatccgcggtgcggctgtggctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424278 - DNA, 2858 bp, Homo sapiens
  misc_feature (2858)..(2858): n is a, c, g, or t
gcggctggacccggaaataggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424279 - DNA, 2838 bp, Homo sapiens
  misc_feature (2838)..(2838): n is a, c, g, or t
ctggattccgcggtgcggctgtggctcttttaggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424280 - DNA, 3425 bp, Homo sapiens
  misc_feature (3425)..(3425): n is a, c, g, or t
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggtagggaaactgaggctcagggaagctgtgcagccaccggggcccagatcggtgcggtacacacccaggcagcttccactcgccgccccctaggccctggctgggttttgagggcacccaggttctctgacctgttatctgtaaatgaagtagggtacttttgtgaacaaattagctggaatccaggggcaataatttctcgcagaagtgaaaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424281 - DNA, 2991 bp, Homo sapiens
  misc_feature (2991)..(2991): n is a, c, g, or t
ccacattcccaggatcatctcagccacttcagctgacctggtagttttttcttgtttttaatctcagatgtcttcaagtttccctaattccctaatttttcttcttcttgcctcaggttggtcttgttttttctttgttaaagtgattttccttgtagtggtgtaggttctattgacagcattgctatcctgagtgtcttttcttctctttaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424282 - DNA, 3293 bp, Homo sapiens
  misc_feature (3293)..(3293): n is a, c, g, or t
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424283 - DNA, 3013 bp, Homo sapiens
  misc_feature (3013)..(3013): n is a, c, g, or t
gactctaactatagctgggtctatatgtagctgaggatataggtgtggtgaatccggcttcgagtggttgccgccccgggaacaaggaccggagctggatccgcggtgcggctgtggctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424284 - DNA, 3050 bp, Homo sapiens
  misc_feature (3050)..(3050): n is a, c, g, or t
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424285 - DNA, 1379 bp, Homo sapiens
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtgctggccacacccgcagagtcctgggcacaccctcactctccctcagccagagacctgcctctactggtccccctccggggcccctaggcctcctcgagccaggatgagcaacaggggatttcaccaaccctgaagaaggccaggcacagtggctaacacctgtaatccctgcactttgggagaccaggataggaggattgcttgaggttggcagtttgagaccagcctgggcagcataacaagaccccatctctacaaaaaaaa

SEQ ID NO: 424286 - DNA, 545 bp, Homo sapiens
tcctgagactggctgcctggttttggggcaagtggtggagagggccagatgtcagcttgcgtatctgcccacctgaacaggtacagctgtgagccattacagccagggctatttggctcccagacaaggaccagcttcatctgtcctggttcttcctggcgttgggctcacctggagactttttcttgtgcgttcaccctttatcctttttcctgcaggttaacactgacaaagacagatctctccttttggactgggaccgagtaagagtgtttgaccgggagatcgcacagatgtttttaaacatgacaaagctggagaaggaagcccaggtgtgcctgctccacccacatctatcacagttgccttgggtgagggtggcccttggatgcctcccgctggaggaacagcctgtgatcctagtccacgtctttctccccctttctgaaacacagacatctttttggaaagctgaatggttactccctcatatactcctaagatatttctgcccagtgcaatagtcacagtgtactgcatgcccg

SEQ ID NO: 424287 - DNA, 458 bp, Homo sapiens
gtacacacagagattttagaactgccttttctgcacgcgtggagcaagagccagagactcatgctccttgcctggcagtgtgtcacaggttctgcatgacagattacatactttgtattatgagaggagtgggggtgggtgccaagtcggtggccccagtgaccctcacgccacctgcctggcattgccgcaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctg

SEQ ID NO: 424288 - DNA, 2977 bp, Homo sapiens
  misc_feature (2977)..(2977): n is a, c, g, or t
gactctaactatagctgggtctatatgtagctgaggatataggtgtggtgaatccggcttcgagtggttgccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424289 - DNA, 2416 bp, Homo sapiens
  misc_feature (2416)..(2416): n is a, c, g, or t
gactctaactatagctgggtctatatgtagctgaggatataggtgtggtgaatccggcttcgagtggttgccgccccgggaacaaggaccggagctggatccgcggtgcggctgtggctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttaacactgacaaagacagatctctccttttggactgggaccgagtaagagtgtttgaccgggagatcgcacagatgtttttaaacatgacaaagctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccagaan

SEQ ID NO: 424290 - DNA, 2554 bp, Homo sapiens
  misc_feature (2554)..(2554): n is a, c, g, or t
gactctaactatagctgggtctatatgtagctgaggatataggtgtggtgaatccggcttcgagtggttgccgccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcctactttgtatgatgaccctgtcctccctcacccaggctgcagtgccatgcagacacctcatggcacttcaaactattaaaatgcattttatcttatccagaan

SEQ ID NO: 424291 - DNA, 1026 bp, Homo sapiens
gcggctggacccggaaataggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaagatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtgctggccacacccgcagagtcctgggcacaccctcactctccctcagccagagacctgcctctactggtccccctccggggcccctaggcctcctcgagccaggatgagcaacaggggatttcaccaaccctgaagaaggccaggcacagtggctaacacctgtaatccctgcactttgggagaccaggataggaggattgcttgaggttggcagtttgagaccagcctgggcagcataacaagaccccatctctacaaaaaaaa

SEQ ID NO: 424292 - DNA, 524 bp, Homo sapiens
tttttttttttaagtgtttctgcttaatgatattttatttaatatactcatggcaacagcactataactcatgattgaacaaagtttatctaacacatatgttttctcaataagatacatcacagccttcttccatttaagaacactagaaagcacttcagtactacacttgggggccatttaaacagtgaaatcaccaacaaaaagcacaaacaggttaaaaaaaaaagcactaaatcaaccacaaaaagacaattgtttatagtgtgagaactgaagtaagaagacaatgttgccttgttcagcctcaattgggaacgagtcatcaggtgacttaaattttgaaccactctgcacatgtccacaaatgaccatgcaagtcctgagtactgattttggagttacaaataaattttagtgagtaggtgaatttgtaaatacagaatccttgaatgaggctcaactgaatagatatacagaagtccctcgctctggggttttgctttccatgatttcagttacct

SEQ ID NO: 424293 - DNA, 763 bp, Homo sapiens
cagctaacagtgagtaccccccactaaccctttggccaacttgagagctgatgctggccaaggattgagttgacagaggggagcgctttgctgatgagattggcgggagcaggcggatgtgggagcccagagccttgtatcagtagcacccagcaagggggcagagggcctccaccactttcccgtttgggaactgttctggaggggcagatgttttgaagctttgaattgctagggacctcggagaagctgctctggtagctgagagaaagagggaggaggtgacagatgtgatggcctctgtgcatcctctgtcacttccgcgcctcctctctcccctcgccatgctctcctcttccttcccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatat

SEQ ID NO: 424294 - DNA, 5810 bp, Homo sapiens
aaagttttaatctcctgacacttgtgatgtcttcaaaggaaccactgatgacactgtgggtgctatcttccatatttttttatgcttatgcagatgtaaatgtatatacctacatatttatgcatatatgcacagcccattctttttaatttttacagaaatgagatcataatgttattgttctaacatgtgtttttttttttttttttgatacgtggtcttgctctgtcactcaggctgcagtgcagtggcatgatcatggctcgctgcggccttgacctcctgtgctcaagtgacccttccacatcagcctctgtagatgagactacaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagagggagcaggccccaagcccacctgctgcctgtgagaagggcaaggagcagcattcccaggccgaggagctgggccctgggcaggaagaggcagaggatcctgaggagaaggtggcggtcagccccaccccgccagtctctccagaggtgcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcacctcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424295 - DNA, 5036 bp, Homo sapiens
atgaggtctctctgttgaccagactggtttcaaactcccggtctcaagcagtccttccatcttggtctcccaaagtgctggaattacaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagagggagcaggccccaagcccacctgctgcctgtgagaagggcaaggagcagcattcccaggccgaggagctgggccctgggcaggaagaggcagaggatcctgaggagaaggtggcggtcagccccaccccgccagtctctccagaggtgcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcatttgggacatatgctgagccttgcctccctcccaccctgctgtgaggcagcctgtgtgatttgcttcgcccagggtacctggtggaactctgggccccagaggagtctactcaccaagtcctcagttcccacacatcacaagggcgacagcctacataccaccttgaatttgtagcaacaaaattgctaggagaacaaatggagatggccatatttcatggatttgcgcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424296 - DNA, 1969 bp, Homo sapiens
acgcgtccggcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatat

SEQ ID NO: 424297 - DNA, 5468 bp, Homo sapiens
  misc_feature (4)..(4): n is a, c, g, or t
gggnggggactgagggaagaagtgaaaatcggactgccaggcgacagttcctccgtttgaaatctcgccggctcctgagcgggccaccgggcccgggctgggggtctggcgggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagaggcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424298 - DNA, 5923 bp, Homo sapiens
gccccatctgccaccgggttcctggtccttttctgctcagctttttagtcagcagtggtcaggcctgcgtcgcctctgactgtgtgtgtagcacagtggggcatcatgtctgcaggatgttacgggttcttctgagggttgggagcacattcccacttcagcttatgtactgttgaaagaagcccttttcctttggtgttttcttcctgcttggaggtggcatggtgggaatgaggggcagaagctggctcccttcaggttcagtgcactgacaaagggaaccatgtcttgtgagtcctaaggcaggactcctctgttgcccacccgttagctgtcatggtacagaggggggccatagtaaacaatccctgatggatcctttgttgcttgtcaggggtctctaggaaccttggaataggttcagagtctccagatccagccatttcctttctaggccagatcttgactttttttttttttttttcaaccaggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagaggcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424299 - DNA, 5544 bp, Homo sapiens
  misc_feature (4)..(4): n is a, c, g, or t
gggnggggactgagggaagaagtgaaaatcggactgccaggcgacagttcctccgtttgaaatctcgccggctcctgagcgggccaccgggcccgggctgggggtctggcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagaggcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424300 - DNA, 1676 bp, Homo sapiens
cagctaacagtgagtaccccccactaaccctttggccaacttgagagctgatgctggccaaggattgagttgacagaggggagcgctttgctgatgagattggcgggagcaggcggatgtgggagcccagagccttgtatcagtagcacccagcaagggggcagagggcctccaccactttcccgtttgggaactgttctggaggggcagatgttttgaagctttgaattgctagggacctcggagaagctgctctggtagctgagagaaagagggaggaggtgacagatgtgatggcctctgtgcatcctctgtcacttccgcgcctcctctctcccctcgccatgctctcctcttccttcccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgttttttt

SEQ ID NO: 424301 - DNA, 358 bp, Homo sapiens
gccccacttttccctctgcacacccctcaccctgggttgaccagtttcttcagagttaccacttgtcatcatttttgtttctagagtgtccacagctcaagtgagcctcttaggaacctacacctggacattggggcactggggggtgactttgagtatgaggtaagagccctaatccctacaggcacatgtgtcagcctggcatatccctcctgtttttattaagccctgctactttgttgtaatgcatatttggaaaaagaaccattttgtcccagtccttccagatgagatttctggggtttggggaaggacaagaataaatgaatggattcctgtcccttccagaccctgcctc

SEQ ID NO: 424302 - DNA, 720 bp, Homo sapiens
  misc_feature (525)..(525): n is a, c, g, or t
  misc_feature (620)..(620): n is a, c, g, or t
  misc_feature (677)..(677): n is a, c, g, or t
  misc_feature (695)..(695): n is a, c, g, or t
cggacgcggtgggcggacgcgtggtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaaanaaaaaaaaaaaaaaaaaaaaaaaaagtctagtctctgagaaggctttgggctccacccaggtcctgatgctacagtggggaccaggccccctggnaatggtggcctcctgcttggtgctgtggctctgagctaaagcctctccctccccttnaggaaccaggctgtgcgnatccagggagggccggtaccgccac

SEQ ID NO: 424303 - DNA, 889 bp, Homo sapiens
agtagctgggactgcaggcacgcaccaccaggcccagctaatttttgtatttttagtagagacggggtttcaccatgttggccaggatggtctcgatctcttgacctcgtgatctgcccgccttggcctcccaaagtgctgggatcacaggcgtgagccaccgcgcccggccaaatttactttaaaggacgcatagcatggatccatatatgcgtctcttgtttttaaaagaaaaatcatttttttctcatttcaaaaaaatcacgttaactataattaatgaagtgcagaaaaatagaaaattattcgtaagctttccagaggcttccatcattaatattttatttcctttcagtcttctaaagttgtttttgcagtagctgaggcctactgtgtatacaatgttgcagagtgtgctttttgcttaacaggaatgtttattaaaacagtaaatatccattttaatatctttataacattctgtcatatggctgttagcatggattctttttccatttattgaatgtgagggatttcgattgtttccagttcttttagttcagtttgtattgaatacatataacaatgtggtttcttactgttggtgatgggtcaacctctagtgatgactatgactccaagaaacgcaaacagcgggctggtggagagccctggggtgctaagaagccaaggcatgacctgcctccttaccgggtccacctcactccttacactgtggacaggtgagtggcgaggctgaggtgggctgagtcttgctgctggtaatagtttcttatgtaaatgagatggcgtctatgcaagtgcacatgtatgttcttacagccttttcttacaaaacgaaaagcacatggaaacctgttgtacatac

SEQ ID NO: 424304 - DNA, 3704 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaa

SEQ ID NO: 424305 - DNA, 4924 bp, Homo sapiens
  misc_feature (4924)..(4924): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccactgtctccttctcttacagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424306 - DNA, 5329 bp, Homo sapiens
  misc_feature (5329)..(5329): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggtaaggtgggggtggaccaggaggcagcacagctcctttccctgagctccaaaagtccccagaagggcgcttgcccgtgtcgggagtgaccagagggccagcaggcaccggcttcgtctttccatcgcttgccaggcagtgtgcccctggttgcaggttctctgggaattgagcagtcagcagcgtgcagtgggagcttcccagcaggaggcagtccgcagtccgcagtcctcagatcaccttgccaggcccgattctgggtacatcatctgtttcaaacaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424307 - DNA, 4696 bp, Homo sapiens
  misc_feature (4696)..(4696): n is a, c, g, or t
atatgacggatcacgtggccgttatctacactgctgggaaacagcctatcagcctcatctgggttacacatggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424308 - DNA, 6054 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaaaaaaaaaaaaaaaaactcgagactagttctctcggcggatatggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcaggttggtaaattcattaatttattcattgatctaattaaaatatactaagtgcccctcacctgtgctaggccaatgtgatacaatgagcagaacagtcatgggccctccctgggaagccctcactagcccaaggactccttgtagacatttaagtgtccacaggctctggagttccaaccttgagtgcaatttagcagctgtggaccttgggcaagtcattacatctaagcctgttttctcttctgcaaaatggttaaggattcaataagataaaactgtaggcaatgaaaaccgtacctggtaacagtaggtgctgaagaagtgttagctattaatttttgcttaatttttctctctctgctctatgtgatgaaaagattcaagaggcaattgttggaatgtaaaaagagcacgggacttggagtcaaatacttaagtctaccatcaagtagttgttaagaattaaacaacaatttttgtgtacccagttaaatgtgggctgcttaggaatgatgactgtgtcttaatgatctctgtattcttagtgacatgtagaatcattgtgcctgacacatagtatgtactcaggaaagaaatggaaaatgtggttttagcattgaaggccgggagagagggtctaacagactacaagccctgccaggagcagagtaagggaaacagaggagaaaagtgtttttagtctgtgcctgaatgtatttacatctgtttgtagcccaaaagccaaaagcgtacatacgcttggcttttctgtagctatgtttatggctttacagcagattttatggagctgcaattactttgatcatgagggactgatgctagtggatttacttcaccaaatggaactcactttgtggcttctgaagaagggacctttgtggactgtcatggagtagttaagagtgcaggctctgatttagtgatcagagtctgcattgtcaggaatgggacaaagtgaagttatgtggcacttgataggatgccctgagaagattgcaacatcacccctgtgatattcctgctgaagatccataacctggatgtaatcatgaggatatatcagacaaacccacgtaaagagacatgctgtatacaaaactgtaatcttagaaagtgccaaggtcatgaaaatcaaagatagaccctggaactgttccaaactggaggggaccaaagaggcatgacgactaaacacaacacatgattctgaactggatctttttgcttgaaaggaagttacagggacagttggaaaagtttaaatggggcctacgatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatcc

SEQ ID NO: 424309 - DNA, 3255 bp, Homo sapiens
  misc_feature (3255)..(3255): n is a, c, g, or t
atgcttactattggtaattatggtaactgcctgccttttccttataacctttgtctgcctctgtagaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttggtatgttgagtggtgagaggggagcttgcaggcttgggatgtggctttccacctgtggccaagctggttttcatttttgtactgtggagttgggtgggccctgctctccatttatcttggcctttctgtagcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424310 - DNA, 2898 bp, Homo sapiens
  misc_feature (2898)..(2898): n is a, c, g, or t
gcaggctggtaccggcccggggtagggataaccagtcagagatggagttctcttcacttcaggacatccccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424311 - DNA, 3810 bp, Homo sapiens
  misc_feature (3810)..(3810): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggatccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424312 - DNA, 4746 bp, Homo sapiens
  misc_feature (4746)..(4746): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424313 - DNA, 5048 bp, Homo sapiens
  misc_feature (4031)..(4032): n is a, c, g, or t
  misc_feature (4037)..(4038): n is a, c, g, or t
  misc_feature (4083)..(4084): n is a, c, g, or t
  misc_feature (5048)..(5048): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagactnncggtnntttttgggggggggtaactacggtattttgttccccggtgggctnnttctctgggttaggggacaacccctttttggggagccaaacaacgggggctttttttttgtgggggagggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424314 - DNA, 3901 bp, Homo sapiens
  misc_feature (3706)..(3706): n is a, c, g, or t
  misc_feature (3801)..(3801): n is a, c, g, or t
  misc_feature (3858)..(3858): n is a, c, g, or t
  misc_feature (3876)..(3876): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaaanaaaaaaaaaaaaaaaaaaaaaaaaagtctagtctctgagaaggctttgggctccacccaggtcctgatgctacagtggggaccaggccccctggnaatggtggcctcctgcttggtgctgtggctctgagctaaagcctctccctccccttnaggaaccaggctgtgcgnatccagggagggccggtaccgccac

SEQ ID NO: 424315 - DNA, 1953 bp, Homo sapiens
  misc_feature (1953)..(1953): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaagagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424316 - DNA, 2741 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatggtgaggcctcttctcgaccactctgggtctcagtggtggtgaggcttggcaaggcctctggcccactcctgggagaaggatgcttaccagtgacttcctttcttgatggacccaacacacagtgtggtccttggctcatggaagggcacgttcataggctccaggagaacatttcagtgtctgttggggtgaatgggagaggaagtgggcagtcctggccatacccaagtctctttcaggtcctcgtcccagtgtggtatatagacacggcttccccactggacccagggaaggagctgcaggagtccacccagtcagggaggcttgctgccgaccatgacgacggtgatgacaggagcggacaccccgagagctgacccgtgccaggccctgttctcagtgctttacgttgctcatccaacttcatcttcagcaacagcctgtgccactcggattggcgttacctgtgcttctcgggtgacggaactgaggtagagctaagtcagctgtccagagctgcgcag

SEQ ID NO: 424317 - DNA, 2627 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttggtatgttgagtggtgagaggggagcttgcaggcttgggatgtggctttccacctgtggccaagctggttttcatttttgtactgtggagttgggtgggccctgctctccatttatcttggcctttctgtagcaggagcaaagctggaggattcggaggtccggtccgttgcctcaaaccagtcagagatggagttctcttcacttcaggacatggtgaggcctcttctcgaccactctgggtctcagtggtggtgaggcttggcaaggcctctggcccactcctgggagaaggatgcttaccagtgacttcctttcttgatggacccaacacacagtgtggtccttggctcatggaagggcacgttcataggctccaggagaacatttcagtgtctgttggggtgaatgggagaggggtatttgatcctctcctgagagaggagcacaggagcttttgccaaagtgggccagagaggaaggctggcttgggcg

SEQ ID NO: 424318 - DNA, 2140 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctggtgagtaccctgccacctcgggctgtcatagtgctcatccagtgctccctgcactctgcatccaccttcacctgcacgtagtgtgtgctacgttactagctgtgcggcactcagtccatgccgagtcaagtgtgttcagggaatgtagtta

SEQ ID NO: 424319 - DNA, 1507 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaaggtaagagctggagagcaggaggagatgcattcacgggtaatgtgcacaacctgtcatgttttgagtgttcggctcctgttcctgaatgcataaaacgaggcatctcagagccgaacacccctcatttcacccaggaggaaggtgcagctcagagctgttacgactagtcagagagagcgaggtggctggttcatgtttgcagatagagacctcactgtgtggtggacttccccacttccggctgccttcatcctgatgggtggcagccttcatcctgatgggtggcagccttgccctgccccacgcgtccgcggacgcgtgg

SEQ ID NO: 424320 - DNA, 1582 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtaagctgacaggcgtctctcacttatctgatttctggaggctgaaggcagctctgagtgtctcctcctgcacaggtactgctgctctcttccccggggttggaggaattgtatcgttgttgcatgctctttgtggatgacatggctgagccaagggagacgccagagcatcctctgaagcagattaaggtaagagctggagagcaggaggagatgcattcacgggtaatgtgcacaacctgtcatgttttgagtgttcggctcctgttcctgaatgcataaaacgaggcatctcagagccgaacacccctcatttcacccaggaggaaggtgcagctcagagctgttacgactagtcagagagagcgaggtggctggttcatgtttgcagatagagacctcactgtgtggtggacttccccacttccggctgccttcatcctgatgggtggcagccttcatcctgatgggtggcagccttgccctgccccacgcgtccgcggacgcgtgg

SEQ ID NO: 424321 - DNA, 646 bp, Homo sapiens
gggggatataggtggcctaatcccgggacccagagggtctcatttcagctgttgtcacaggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggcaggtgtcaagagtcttggggaggctgtgggctgggatttgtgggcctgaagcagtctttcttcctgatgctcatggaccctcccacctccccagtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctggtgagtaccctgccacctcgggc

SEQ ID NO: 424322 - DNA, 361 bp, Homo sapiens
ctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagctgtgcagcagcgtgcctttggggatatgcagggcacggaagggctctagctgagactgaaccaaaaggagccggggagcaacagggcctcagtggctggaggtggaggcgcccctgcttcgggctcctggttcccccagcagcaggtgcaggaaggcatgggcct

SEQ ID NO: 424323 - DNA, 711 bp, Homo sapiens
aggcatgaatatagtgcactgcagcctcgaactcctgggttcaagtgattctcctgccttagcctccccagcagctgggacttcaggcatgcatcactgcatgtggcccaagccactggattctggacaggctgaatcctgggcgatagagccactgagggaactatttgcaaatcctgctcatctttgttttctttgcagcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggtaccttctttcctctgccccagcacatgggcacaggcctgcacttactcctgctctaggttcccgcccatggccagggtcggggacggggccttctgatcagcagatgtgttttctgcaggccaagcagctggtcagcagggtggtgacccagaacatctgccagtaccggagccttcagtacagccgccaggagggcctggatggtggccttcccgaggaggtgctcttcggtatgttctggggccctgcagccttcctggggcacgggcagggcaggctgccctctctggagactccatcctgaattctttttcacggttctctctaggaaacctggacctgctgccccctcctgggaaa

SEQ ID NO: 424324 - DNA, 5047 bp, Homo sapiens
  misc_feature (5047)..(5047): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424325 - DNA, 5293 bp, Homo sapiens
  misc_feature (5293)..(5293): n is a, c, g, or t
ggctctgctgggagacccggcgctggcggctgctgaggccggagcggagggcccgggagcgtgggagcaggagggtggcgcgcagccggtttcgcgtttggtcggccagggagctgccttcccaccagccggtcgaggaaacaacgggtcgggcttccggggagagggcccacacagtctcctcgccggcaccggcctcctccatttttccgggccttgcgtggagggttttggcggatgtttttgaacgaaggaatgtcatcggggctctctcgagcccctcaccccgccagctactctgggggtggcgtggcatagtgagaggagcgctaagttgttgggaggcctgggtccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424326 - DNA, 4994 bp, Homo sapiens
  misc_feature (4994)..(4994): n is a, c, g, or t
tttttagcaactacacagtattcattgaatggatgaacatgatttatttacccagttctccatttgcactctatcctaaattttcttggaatgaacatccttctacctacacctgtgtgtttgttgcgatcaatttctagaaatggagcagctggctcaaaggctttgctttaagcttccatagctattgccagttctcctgaagaggctgtgccccttctgctctaaccagtggggtgtggagaccttatttccccgtgccgttgccaacactgttagccgactttttcatctttgtctgtctagttggtgacacatgataatgtggtttgcatttctttaattgtaagtgagattgagcatattttcctggcctctaattcttatgtatttctcttaagaacctattgatgtcaattttccgttttaggcttttgaactttttgttactgatttgtgagttcctttatattaaggcaatgacccatttctctgtcatgtgttataagtgttttcttttttccctttcccagtttgacttttgccatctagagtttgtaaattaagtggtcagatctgatctagcttccttgagaggtgccttacttcaaaagttctcagactgaaaaaaaattcgcccattttttcaaatctttgatggtttcatttcgaatgttttagtctttgctcagtctggattcccttgctgtcttcctgtagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtaagctgacaggcgtctctcacttatctgatttctggaggctgaaggcagctctgagtgtctcctcctgcacaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424327 - DNA, 4942 bp, Homo sapiens
  misc_feature (4942)..(4942): n is a, c, g, or t
agtagctgggactgcaggcacgcaccaccaggcccagctaatttttgtatttttagtagagacggggtttcaccatgttggccaggatggtctcgatctcttgacctcgtgatctgcccgccttggcctcccaaagtgctgggatcacaggcgtgagccaccgcgcccggccaaatttactttaaaggacgcatagcatggatccatatatgcgtctcttgtttttaaaagaaaaatcatttttttctcatttcaaaaaaatcacgttaactataattaatgaagtgcagaaaaatagaaaattattcgtaagctttccagaggcttccatcattaatattttatttcctttcagtcttctaaagttgtttttgcagtagctgaggcctactgtgtatacaatgttgcagagtgtgctttttgcttaacaggaatgtttattaaaacagtaaatatccattttaatatctttataacattctgtcatatggctgttagcatggattctttttccatttattgaatgtgagggatttcgattgtttccagttcttttagttcagtttgtattgaatacatataacaatgtggtttcttactgttggtgatgggtcaacctctagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424328 - DNA, 3564 bp, Homo sapiens
  misc_feature (3564)..(3564): n is a, c, g, or t
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424329 - DNA, 2960 bp, Homo sapiens
  misc_feature (2960)..(2960): n is a, c, g, or t
cagctgggacttcaggcatgcatcactgcatgtggcccaagccactggattctggacaggctgaatcctgggcgatagagccactgagggaactatttgcaaatcctgctcatctttgttttctttgcagcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtcaagctgatgggacaggtctccaaagatcttgtgcatttccgagtagtacacaacctgggggaggcgacaggggttggcacgtgctggctccagggaaccgtgtgcttcagggggccagaggctcacacttctctgctaccccctgcccttacccatctggagcggccaccactgtgctttgcgcatattcaggcacactggaagtatttagctgccagtaaaccgaaaccagtcgccgaacgacaaggtcagcagcaggaggaggacagcagcaggaggaggacagccgcaggaagacgn

SEQ ID NO: 424330 - DNA, 3001 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccctgagctgaattcagcggttgtgaaaggctacactggttgagagagaccgaactacaatacggctgacgaatgcattgtagcaacgtggccgcaattactcgtacaaacacagggactgacagaggtgtaccgtacttagagacatgtggtttttgatttaaccg

SEQ ID NO: 424331 - DNA, 3128 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccgatctgagccgttaggccgatctgagccgttaggccgatctgagccgttaggccgatctga

SEQ ID NO: 424332 - DNA, 2872 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttggtatgttgagtggtgagaggggagcttgcaggcttgggatgtggctttccacctgtggccaagctggttttcatttttgtactgtggagttgggtgggccctgctctccatttatcttggcctttctgtagcaggagcaaagctggaggattcggaggtccggtccgttgcctcaaaccagtcagagatggagttctcttcacttcaggacatggtgaggcctcttctcgaccactctgggtctcagtggtggtgaggcttggcaaggcctctggcccactcctgggagaaggatgcttaccagtgacttcctttcttgatggacccaacacacagtgtggtccttggctcatggaagggcacgttcataggctccaggagaacatttcagtgtctgttggggtgaatgggagaggaagtgggcagtcctggccatacccaagtctctttcaggtcctcgtcccagtgtggtatatagacacggcttccccactggacccagggaaggagctgcaggagtccacccagtcagggaggcttgctgccgaccatgacgacggtgatgacaggagcggacaccccgagagctgacccgtgccaggccctgttctcagtgctttacgttgctcatccaacttcatcttcagcaacagcctgtgccactcggattggcgttacctgtgcttctcgggtgacggaactgaggtagagctaagtcagctgtccagagctgcgcag

SEQ ID NO: 424333 - DNA, 2520 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctggtgagtaccctgccacctcgggctgtcatagtgcttaccgtgaccgcgcacctttaccccgggctctgttccgagcgcttcctgtgccctagctcattccctgcacccttgctcggcatggactgaggccgcacagctagtaagtagcacacctagtgcaagggaaggtggcgcagagtgcagggagcatggctgagcagcctgacagcacagaaacccttgtcactgagaacgcttggcagagtggggtgctttgattgcctgatggttaactagaaaattttgtaggccgggcgctgtagctcacccctgtaatcccagcactttgggagaccgaggtgggcagatcatgaggtcaggagtttgagaccagcctggccaatatagtgaaacgccgtctctactaaaaatacaaaaattagccgggtgtggtggtgcatgcctgttttctcagctactcgggaggctgaggcaggagaatcgcttgaacccgggaggcggaggttgcagtgagccgaggtcgcgccactg

SEQ ID NO: 424334 - DNA, 1309 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgagcacctctttcccgtggctcctgtgttcagaatgtggtattggctctggcccagccttctcccctgttacccataattcttgcctctttccataatccgtggtttcagtttgactttgtatataaagttggggtttttttttttttttttggcttgttttttaaataaaccaaagtcaaaaacaaa

SEQ ID NO: 424335 - DNA, 678 bp, Homo sapiens
accagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagctgagtctcttccaaacatcccacggaataaggtggtacgagctgata

SEQ ID NO: 424336 - DNA, 353 bp, Homo sapiens
tgagtgctgactggaaactgaagcccttgcctgtgaacgtggtgtctgcgtggagttgtcactaaagaagttagtacctccttttgccatgtgcaggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggtaaggctgtgccttagccagcagcgggggatataggtggcctaatcccgggacccagagggtctcatttcagctgttgtcacag

SEQ ID NO: 424337 - DNA, 128 bp, Homo sapiens
tcagctgagaccgacttctaaggagttcctctgaggtgtcccgtatcttcctgattcacagtttggcttctggctagaatggtttccaggaacatcttcagccactgctcagtgattacggtctctgt

SEQ ID NO: 424338 - DNA, 384 bp, Homo sapiens
  misc_feature (354)..(354): n is a, c, g, or t
  misc_feature (362)..(362): n is a, c, g, or t
gtgttctataatcagctgagttgctgtggaggttaatctaagccacagatagagcggagtgtccattatcatagatattctgaaggatcgaatcctttgcatcttggaatggctgtaacatgagtgcactgttgtccagctcttttacacttgtactcctagagtcatcttctgacttcaggagaacttgatagaacatgctgttcactaaggatcattgatattagattgcatacatagtacttgggcaactgaaatccctcaacagtaaaatatgggtgttcttggcatatatgctattaggaacttaaggaaaagggtaccaggaaaaaaattaagttctggacacacttntttttctntttaaatttaaatccgtcacgg

SEQ ID NO: 424339 - DNA, 6783 bp, Homo sapiens
tcgggctaatcgccgggcggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaggccac

SEQ ID NO: 424340 - DNA, 330 bp, Homo sapiens
  misc_feature (313)..(313): n is a, c, g, or t
cttggagagcattcaaggaaaaagtccagaaagtgcgctgtcagaccacgtcactaagagtttcatcaagctcttagagatcgctcctgcagggcccactgctgtgcttttctgaaacatccatttattaacagagccccactattttaacatgttccaggccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcatattgantgcgggccggctcatta

SEQ ID NO: 424341 - DNA, 7182 bp, Homo sapiens
tcgggctaatcgccgggcggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaggccac

SEQ ID NO: 424342 - DNA, 5714 bp, Homo sapiens
cttggagagcattcaaggaaaaagtccagaaagtgcgctgtcagaccacgtcactaagagtttcatcaagctcttagagatcgctcctgcagggcccactgctgtgcttttctgaaacatccatttattaacagagccccactattttaacatgttccaggccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaggccac

SEQ ID NO: 424343 - DNA, 4614 bp, Homo sapiens
gcatttatgaaaggcactcagctcttcttcagtataagaaactgcacgaaatgtgctgggaagaagaaatcttgagattgttactacctgacattagaaaggaaaattggacatccctgcttaggcttaactgttgttacatacatggaagaaaagacaaagaagctgtcctttgtttccatcaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaggccac

SEQ ID NO: 424344 - DNA, 3511 bp, Homo sapiens
tcgggctaatcgccgggcggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcagcaggagccccatcgagccctcagccctgggagccggcgtactaccaaggtgtgtattccagacccgtcctaaaca

SEQ ID NO: 424345 - DNA, 2769 bp, Homo sapiens
tcgggctaatcgccgggcggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtagatgtacaccatt

SEQ ID NO: 424346 - DNA, 413 bp, Homo sapiens
aaagaaacatccagcagtggtagcgaataagaggatatgattcagagagcactggaatttttccccttttaaatggaacaaagagtgacctggacagttgttttttgccttgtgatttgttgcatgtgtgtgagaagtgatagtgcctgtaagtgaggtgcccatattgggggagaacttttgtgttttgcatgaggctcgcatctcagtgttggagctgacttctgctttgagttgcttatttgcatgggcctgtgaccttgtgtattgtacaactaaatcatttattttctttctcttgagaatgtttttaaatgtatacatttttggttttgttcttcaaataggaaaactccagagatgaaaaccgagctctagttcatcagctttctaatgaaagtagactctccatc

SEQ ID NO: 424347 - DNA, 208 bp, Homo sapiens
gagccaccagttcagaaaggatttttgctgaaaaagaggaagtggcccttaaaaggctggcataaggtaaggttggtcttggcctcccctttatttgcactcacactgccccactcagcacctggttcttaggtactcatatttaatttctagttggaatttgagaccaagaaaagggcacctaaattgaatgccttaattaataata

SEQ ID NO: 424348 - DNA, 508 bp, Homo sapiens
cttcgccaccacagaatgtatcgtcagaatgaaattgccatgtttccacatgaagttaaccactttttctcagggtccaccatcacagactcttcatctggggtgtttgactccatttcaagtaggaaggtaatgagtgttttgccaataatgaatctgagaacggggtggctttgtttcatggagtcctgtcttgggagctgagtccgaagaaggaaaagttttcggggacaagcagggtaggcttgggctggtatttaattagtctgtttgcccactgagtcagaaccaagaccagacaagcatctattagttggggcgggggcggacagtgactgaagaataaggaggaatttagcatctctgaatgaactagctttatcctgactggtttgagtttggtttccttttctggttgtaaactacagtaggtatgcatatagctatgcaggattgcaaaatatttccaaacatttatattattattttgatgttattaatatttgat

SEQ ID NO: 424349 - DNA, 1039 bp, Homo sapiens
ctaggctggagtgcagtggcacgatctcagctcactgcaatctctgccgcccgggttcaagcgattctcctgcctcagcctccccagtagttgggattacaggtgtgtgccacaacgcctggctaatttttgtatttttagtagacacggggtttcagcatcttggccaggctggtcttgaattcctgacctcgtgatccacccatctcggcctcccaaagtgcagaaccagattcttaactgccacagactcttgtattatgtaatttatatacagaacacaaagcacttgatttgcttaactgatgtacttgatgatactataaaacctatattatgagaaagcattgctccttcaaaggaatcaagtgatagcaaacactcggtcctgtttccaggttttcctcactgttcattttgcctttgttcttgcaggcggagaatgaaaggggcgagagtaaagtgtgttgtcaatgcaagtcaatcattaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattatccagggaatgtcactacggattaattatgttaatgaggccatcaaaatctatggtaatctttcaggctttgttgtttgataccagatacagcaaatgagataataatgtgtctaattgtgcctagccagtattggtatttaataaaactttgtcattgaatcttta

SEQ ID NO: 424350 - DNA, 2117 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424351 - DNA, 1980 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcaggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424352 - DNA, 2165 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcgaaggagactcagatggaggggcaggattacacactgaatcattggcaggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424353 - DNA, 1342 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggcggagaatgaaaggggcgagagtaaagtgtgttgtcaatgcaagtcaatcattaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattatccagggaatgtcactacggattaattatgttaatgaggccatcaaaatctatggtaatctttcaggctttgttgtttgataccagatacagcaaatgagataataatgtgtctaattgtgcctagccagtattggtatttaataaaactttgtcattgaatcttta

SEQ ID NO: 424354 - DNA, 2061 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaaggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424355 - DNA, 1654 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggcggagaatgaaaggggcgagagtaaagtgtgttgtcaatgcaagtcaatcattaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattatccagggaatgtcactacggattaattatgttaatgaggccatcaaaatctatggtaatctttcaggctttgttgtttgataccagatacagcaaatgagataataatgtgtctaattgtgcctagccagtattggtatttaataaaactttgtcattgaatctttaaaaaaaaaaccacctaacaaacaacacaaaaaaaaagaagggggggagcggtaaaaagattccccgtggggggccagtgttaacctttacccggcttttttgcaaaggcggccccattggggagcgaattaaaagaaagccacgggccggggttaaacacgtggtcgggaacagggtgcttggccttttggagaccccttcttggtgggtgcccatttcgacccacctccggattaggctggaattaaaactacaggttctggtgacaccgcatgcggggaatgtggatattactacatctgactaattagt

SEQ ID NO: 424356 - DNA, 853 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattattaactggacttcctaatatatacttctatcaagtggaaaggaaattccaggcccatggaaacttggatatgggtaatttgatgacaaataatcttcactaaaggtcatgtacaggtttttatacttcccag

SEQ ID NO: 424357 - DNA, 753 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcaggtatgtgcggaaagggtcatatctgacagtaggggattagagggtgtaattgcagacacctctgctgctgagccggattcacctggcctcggggcgggcaggccacaacctagaggtttcgtgcaacgcttcggggtgcttagagaaaatatattgaaatccatcattagccagatacgggtctgaggaatccacctcaaaatccagttggatgaacacaaatatatatagtcaagaaggggttctttgtgcaaatcgtgctagaaaagcctttttaaaagcctgcttttttagcctgcttatcgtggataccacatccttctttccgttgcctgttctatccctccccctatgagggaccgtttagtaaaatgggagcataaacggtgtggactctgaatgcatagccgttttcctgcagctaggatccctccctcgctcctttgatttctgggaacttcatttacaatgtcaactagaatgttaaagcaggaagagcccttagaaatcttttattacacaggttcccaaacttggttccgccacaaaattacccagggcttta

SEQ ID NO: 424358 - DNA, 2063 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagtagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424359 - DNA, 1983 bp, Homo sapiens
agaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctgacatccaggctgcccaggccatgatggtgacgatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaaccctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactc

SEQ ID NO: 424360 - DNA, 1025 bp, Homo sapiens
ttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacagggcggagaatgaaaggggcgagagtaaagtgtgttgtcaatgcaagtcaatcattaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattatccagggaatgtcactacggattaattatgttaatgaggccatcaaaatctatggtaatctttcaggctttgttgtttgataccagatacagcaaatgagataataatgtgtctaattgtgcctagccagtattggtatttaataaaactttgtcattgaatcttta

SEQ ID NO: 424361 - DNA, 525 bp, Homo sapiens
tcccaactcacggctgctttgtccacttcccagacctgcagccccagcacctgcccaccttggcatctcccattaagtcacataatgagggcagagagcaggggcctgtttttgcggacacttgaagtacagcatggaccaggcagagcaaggcgccggatcagatcagttccagaagatatgcagcagctgctctgatttcagtgaaatgtgtgaaaccatgcacaggactttggacaactctcagctgtagcaaatccagtttccccttgggccttccagaagcagggtcctgtctccgcgcaggagcatctcccgtggcaatggctgcacctcggcatccgcattaccagtgcttgcgtggcagtccactaatcgggtgagaaccatattgctttttgcatctcaatgaagcaatagtagcaatttatcaagcacttttttttccagactggtataaaattgtatgtgcttttgtaaaccatttaacaataaaagtaaaatacaaaagggaacagggaacgg

SEQ ID NO: 424362 - DNA, 1077 bp, Homo sapiens
  misc_feature (835)..(835): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggaggtctcaggnccttaaggggagccttcgttggttggcctcccggtttcctggcatcttccaggcgtccttttccacttgtgttctgtgttcctgaaacttaggggacacacttctggacaattcacaggccatttggaggggcgttgcacgccctcactagcggtggacacgcctgtgtctccagtggccagccagagcctgctgccgggccgaatccaccctggcctgttgggggccccctgtgtcccccc

SEQ ID NO: 424363 - DNA, 3509 bp, Homo sapiens
  misc_feature (3501)..(3501): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgagggttcacccctgtgcagcctccccgccatgcgggggagggccttcgccaaggccaccacactgcaggaggaggacagggagcatttgtgatgacaaacatcatggactaatgcggccatgatttgacagcagcttgtcaccaagcactcactgcaggcctgtccatgccagtggcactcccacaccacgcctttaacctctgtggtgaacccaccagaaggcactctcacagccccagcttatgacgggaaaactgagggccaggaaggtgaagtgactcaagagtttgtgggtccttttggacaagtgactttacctctctgagcctcagtctccccctctgggaagtgggggtaatggcagtgcctccctcagcaccattttgaggagtgggaggtgatccacgtgaggccttcagcaagagctgcggcccacggacatttggtacccagcagctgctgcgaagacgaccgtcggggctgagggttactcgctgctgcttctgtgccggtacctcccatttcctcggcccagagggtctgctccgggaactttttgcagttcgctgaggtccaaggcggggtggctgccacccagtcagggcttctgcggccaaggtgccagaacaccaagctggccgttctctgggagccgggcctgcccctctcagaggcatccaggccatgctgctgcgccctgggccgttccccgggtgccccgcccactgccgccctcccgcctgcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424364 - DNA, 2290 bp, Homo sapiens
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggcacggtggctcacacctttaatcccagtgctttgggaggctgaggcaggaggatctcttgagcccagaaattcgaggctgcacgcacctcggcatccgcattaccagtgcttgcgtggcagtccactaatcgggtgagaaccatattgctttttgcatctcaatgaagcaatagtagcaatttatcaagcacttttttttccagactggtataaaattgtatgtgcttttgtaaaccatttaacaataaaagtaaaatacaaaagggaacagggaacgg

SEQ ID NO: 424365 - DNA, 2389 bp, Homo sapiens
  misc_feature (2381)..(2381): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424366 - DNA, 2190 bp, Homo sapiens
  misc_feature (2182)..(2182): n is a, c, g, or t
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424367 - DNA, 2192 bp, Homo sapiens
  misc_feature (2184)..(2184): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424368 - DNA, 3313 bp, Homo sapiens
  misc_feature (3305)..(3305): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgagggttcacccctgtgcagcctccccgccatgcgggggagggccttcgccaaggccaccacactgcaggaggaggacagggagcatttgtgatgacaaacatcatggactaatgcggccatgatttgacagcagcttgtcaccaagcactcactgcaggcctgtccatgccagtggcactcccacaccacgcctttaacctctgtggtgaacccaccagaaggcactctcacagccccagcttatgacgggaaaactgagggccaggaaggtgaagtgactcaagagtttgtgggtccttttggacaagtgactttacctctctgagcctcagtctccccctctgggaagtgggggtaatggcagtgcctccctcagcaccattttgaggagtgggaggtgatccacgtgaggccttcagcaagagctgcggcccacggacatttggtacccagcagctgctgcgaagacgaccgtcggggctgagggttactcgctgctgcttctgtgccggtacctcccatttcctcggcccagagggtctgctccgggaactttttgcagttcgctgaggtccaaggcggggtggctgccacccagtcagggcttctgcggccaaggtgccagaacaccaagctggccgttctctgggagccgggcctgcccctctcagaggcatccaggccatgctgctgcgccctgggccgttccccgggtgccccgcccactgccgccctcccgcctgcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424369 - DNA, 2123 bp, Homo sapiens
  misc_feature (2115)..(2115): n is a, c, g, or t
agcgaggaggatgggttcagtggggaggggagggtcagggctgtaggaggtgcttagctagggccaggcccagacctgaggcaggtgctggatgtgttggtggtggcagggatgagggcagcagcttgctctttgcccagattacctctttgtggctcccccccacctatcaggaagtgccctgggcaggtgagggtcatctcacctgacacatggggaggctgggacttgtctgcacacctgaggacacagggggtgctgggatgaggagccaagacgtgggagtcagcgctccccaagccttaggacagtagacccccagaggggggccgcttgcgggaggggagagagaaatcctgatggccagtatccgtcagagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424370 - DNA, 2112 bp, Homo sapiens
  misc_feature (2104)..(2104): n is a, c, g, or t
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424371 - DNA, 381 bp, Homo sapiens
gaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccctcttttgctctgcaaacctgcggatgatccacaggagcccactccctacattttggttttcatccctggcttcgggtcaatgactgcaattagcaggaagttcctgtcctg

SEQ ID NO: 424372 - DNA, 2143 bp, Homo sapiens
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaa

SEQ ID NO: 424373 - DNA, 2759 bp, Homo sapiens
  misc_feature (2751)..(2751): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424374 - DNA, 2848 bp, Homo sapiens
  misc_feature (2840)..(2840): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424375 - DNA, 2552 bp, Homo sapiens
  misc_feature (2544)..(2544): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424376 - DNA, 2651 bp, Homo sapiens
  misc_feature (2643)..(2643): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424377 - DNA, 2132 bp, Homo sapiens
  misc_feature (2124)..(2124): n is a, c, g, or t
cgcagctggtgtgattggcccgtgccatgtgccttcatgaacagttgtgataatggcaatgtcagtagcgaacatgagggcagatgtgcagaggcagcgaggccccatctctgaagctgagtctttgaggctggcaaggcccaggctggctcaccctggctctgacgccagcctcctccacccaccccccgcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424378 - DNA, 2435 bp, Homo sapiens
  misc_feature (2427)..(2427): n is a, c, g, or t
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatgctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctaggcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcaccactgtactccagcctgggagacagaacaagaccccaaccccncccccgca

SEQ ID NO: 424379 - DNA, 1819 bp, Homo sapiens
aactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatgctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaa

SEQ ID NO: 424380 - DNA, 495 bp, Homo sapiens
  misc_feature (495)..(495): n is a, c, g, or t
ttttttttttggtatttttagtagagatagctgtgttgaccaggctgcgaactcctgacctcaagtgatccgcctgcttcggcctccgaaagtgctaggattacaggcatgagccactgtgcctggcctggggtttctaattttcttaattcttacaacttcttatgaagacttttactaatatggctttttccaggcttcccaaactgtatttcaggttataataattttattgttctgtttcttgcagagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggtaaccctaagcagggctggatgggaccttaatgggtttatttctcatattatggaacacagaattaatttctcactattgagataaaaaaaaaagatn

SEQ ID NO: 424381 - DNA, 3925 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424382 - DNA, 3854 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424383 - DNA, 3996 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 424384 - DNA, 4794 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagtgagttcctatgcagtatttctatcttttatttttatccacaaagtctatactggggacaagctagagcttgccttcactcaaaatggccattcctgacattcagcagggaatgtcatttgatttgctccttttgtacctgtgtgaccaattggtaatacatagattcacatggctttcccccatattgaagatggaatttttgatcaactgtgacatccaaagcaaatacgagctttattcagcttgcttctttttaaatccaaaattaatgtttattctgataaatcaagtggtagagtagtgtgggatctattgatggcctctggtaacatctaacctctgtctcttagtaagtgtcctgtttgtggttcttgtatttcaagctggaacattaattactgtccattagtctcttttcccccattgttcagttgtggagtgatgagaatcagagtgagtggtagccgtttccaggtttgtgacctttctaattagcgttaacttccaaacttggattgttaaagccacagcatgtgttctatggctctgggcagggttgatagacaccccactccaggaaggctgtggaacagacagatttgtaagtcttctattaaacaagttgcaacatttaatagtactaactgtttaattcatttcttctgattgttcttctgaatattgctattattaaaggaatcattgctagtaaggatcttgccttacttggtaggtatgttaactgtgcaattatctggtacactatgtgcgctaattacaggagcagaaacattctcaattgtacttgggtgtgattatgttcttgtgctttcctgcaggaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagactaactttgaataattggacctgcagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424385 - DNA, 3952 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagactaactttgaataattggacctgcagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424386 - DNA, 2694 bp, Homo sapiens
gaactgacgttttaattattgtggtaggggcctacgcaggagggaaagggtgacctggaaggcctggaaaaaatcaggtttcatttcttacctgtacatatgcgctatgtgaaaaattactctgaattgggacttggaattcagttatggctgcttagagaatccttcagttgcttgccatggttattgttaaggaaagctctacaaagtagtggggcatacaaattaggtatgtacaccaggtggagagcaaggtgattggaaaggagaggtgagttttgagctgcacttgacttgctgaaggcccaaggagaactgggattgttcaaggtcttctcgatgcaggtagaaatataatgcctagtccttgttcaggtgccctgtggctccaatgtcacaatcatctgtttcatttcttccttctcaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424387 - DNA, 1720 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaagaaagctaccatctgtcaagaaggcaaataacttcctgtggcctccaattgtctgctcacgagcttggatgtcagaaaaggaaccccagaaacaggaccgggttcggataaggtttcgactgataaagtttagactaaacaaaaaaaagggggcgctagaattccgaaggccagtcctccccttttaaagggccaaggagtatacaacgcgcgttcaagttcagaacatggcgttacacacactgggaatgcccccaatccaaattagaatgcaggtaaaaac

SEQ ID NO: 424388 - DNA, 285 bp, Homo sapiens
gggcaaccagctcttcttctggatttggaaagtcagctccaccacagcttccttctttctacaaaattggatctaagcgggccaactttgatgaagaaaatgcgtaagtggtaattcctggtagtgtagcaaagtttggactttgatatattcattctatcagcagaaattgaggcaaagaaactttgtttctcaaataataatgaattcttaaattatgtgtctcgctgaattccattgttcctaataagttaaattatcaggtttactcatttgtaaggaatg

SEQ ID NO: 424389 - DNA, 500 bp, Homo sapiens
atcatcccatttaaaagaaatgcaaactgcagattatagagtgcagctacacatatatataatggggtggatagtttatagtgtgctcattgctgctttgttattattagtgttgagagttcctgtgctgtgtggaattcaacactaatctgctgtaagtatggagctgggtatgtggaacatttgcagggaagtttgtttctccgcttgtttttccaggggtattcgagatgacattgaagaggaagatgaccaagtgagttcctatgcagtatttctatcttttatttttatccacaaagtctatactggggacaagctagagcttgccttcactcaaaatggccattcctgacattcagcagggaatgtcatttgatttgctccttttgtacctgtgtgaccaattggtaatacatagattcacatggctttcccccatattgaagatggaatttttgatcaactgtgacatccaaagcaaatacgagctttattca

SEQ ID NO: 424390 - DNA, 767 bp, Homo sapiens
ctaggtgcagtttgaacagggcttgacagtggctggaccatcactaagtgagactttaattcatcaagcataactgaaaatggaggcagtagattatatcttggtagccagcatgtgtagacttgtcttatttggagcccacttggaattttcatttcaagagtaagatacattaatttttttctaccatctggttaatacttaatgcaaaatggcaaaagaacagttatggcttcccaattcattgaacaattttttttccgttttatttgttatgagaaaattaattttgagttaagaaatttttaatcatttaaaattgtatgacaattatcttgggaatatttatcatggagtttttaatatgaggtttatatttgttaccatttgaggtttttccttttcattgtatgattttggcttacagacttgtatttttacttcatactccagctaaaatgctagatccaggtaagtattgttgaacttcaaatgctgttaatgttgaagtacaagtcattctggggagttgtctctatctctaggtctctggtgctgcacctcctagaccaggaagtagctttgctcattttgggtttgacgaacaacttatgcaccagattcggaaatctgaatacacacagcccactccaatacagtgccaggtaagtaaaacataatgaaagaaaaataaagtagggtagtctttcatgactatattaatttaaaaacaaatcacagcagtaaaacagtgtttagtgtagaac

SEQ ID NO: 424391 - DNA, 448 bp, Homo sapiens
aggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggacctgtggatcgtttgtcatttctgtctatgaattggtacatattaagaatagtgccgcacacagtgtagggacagatagggaagtgcttattaaaactgtcagaaaagac

SEQ ID NO: 424392 - DNA, 3888 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424393 - DNA, 4155 bp, Homo sapiens
cggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggaaaaaaaaaaaaacaaagaaaaaacaaattgttggggccgccgcccgaaaatttaaaaactcgtgggggggcccagtaagaaacggaaggtccagaacggcgaaagggggtccccaaaaaccggggcgggtgaaacaggtctggtgggtaagcgaaacgg

SEQ ID NO: 424394 - DNA, 2060 bp, Homo sapiens
cggctagtacgaggctcgtgttaatcggccgaggaggacatcccagtcttggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtg

SEQ ID NO: 424395 - DNA, 1742 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424396 - DNA, 2111 bp, Homo sapiens
gcgggaacaatccagagggacgcttggctgctacgcgggattgcagtggtgcagccagccccgaagtcggaaggtgctctctagggagtacaggaagataaagtttgtgcttgatttagaattagctagatcctttgggggagaggggatcgagccgatttcgggaggatgttcactgcgcggatgatgctcaggccatcgagaaatccagaaacaggcgacgaccttcgtcaagagaaaaatgatcctgtggagaaaagtaaatgtcgctaggttgggatggatggtaacaggccaagccccggacctatatctagccacattttttgtcaaggaggaaaccaattctgtagagaaaagtacctccctgtcccttgcaaggaccagtgtcaggcaatcctagtgccactatctggctactgcatgtcaaggagccaatcccatgtagaaataaactgcctcttactccctggatgctatagcctgaagcaggccacactccccagaaatgagggacccaatcacacaaggatgcaaatcctgactccacccctccaatcctcagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggtgataagaggcaaaacaagggagtgagtgaggcctggagtccacctctggccccgggtcacccctgccgcttcatacctgccgtaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424397 - DNA, 331 bp, Homo sapiens
gcgggaacaatccagagggacgcttggctgctacgcgggattgcagtggtgcagccagccccgaagtcggaaggtgctctctagggagtacaggaagataaagtttgtgcttgatttagaattagctagatcctttgggggagaggggatcgagccgatttcgggaggatgttcactgcgcggatgatgctcaggccatcgagaaatccagaaacaggcgacgaccttcgtcaagagaaaaatgatcctgtggagaaaagtaaatgtcgctaggttgggatggatggtaacaggccaagccccggtcaacccacagccacggtcaacccac

SEQ ID NO: 424398 - DNA, 1992 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggtgagtacggggcggggcggaggcatgtgcgaggctctctgcctgtacgctggaaagtggggattgcaactcggggagggatggagcacgcgtcgtcgcctgggaaacgggtcgacccgcggaaggcgagcgggtgggacttccggagcagttaatggtgggaaactttctagtggatgtgggaggaggcgggacttcctgcagcaaattggggctgtgcgccgctcaagcccgtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424399 - DNA, 1854 bp, Homo sapiens
atcctttttatagatgaggaaactagaacatcgagggtgaagccaaagaaggacttaggggcgctgtcgggggcggaggtttcctcgactgacaatgaccatcagatgggaaaaaaatcttcctccctgggatgaaaattagaagtcaaggtggaaagaggcaaatctgctaacggaggatccagtccccgctaccggcctgagcctcgcgttgcagcaagagagatgaaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424400 - DNA, 1922 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccgggtgagcccgctcagcccggacaccccccgggctgcaccccctgacccccctcctcccctgacccctgggcctgccgcccctctgatgttccccacagtttcgagagatgacggactcctctcatatccccgtgtcagacatggtcatgtatggctacaggtactgttggggatagcagggggcaggggcactggctgggccacatgatccaggctgtccctcactgttcccaccactgccaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424401 - DNA, 1839 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccgggtgagcccgctcagcccggacaccccccgggctgcaccccctgacccccctcctcccctgacccctgggcctgccgcccctctgatgttccccacagtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424402 - DNA, 1825 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggtactgttggggatagcagggggcaggggcactggctgggccacatgatccaggctgtccctcactgttcccaccactgccaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424403 - DNA, 1499 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagttcacctttttaaagaagcaccacgagaaggacggaaatatccacgtaaaacaagggacacgctaagctcctggcaacgctgagagaccacatgtggaaacgcccaaaaaacaaggtaaaagggtcgacaacgtacaacaataaccccaaaccccaagagccgagccaggaacatcacaatgagccccaagccacagggcttcacctgccaattgatttctttttaaccgtaa

SEQ ID NO: 424404 - DNA, 1711 bp, Homo sapiens
tctgacgttctcgatcggcccagtcttctcgtcccaggtcgctgcccgagtggcgcctatggtgagtcgtatcatttgcttaggcgctgagccgccctgtgttgcgagcgttcgctgcaactgttcactagctgtctagacttggcgatctctctgtgtccgtgagccttgacgtatctgtggatgctgacgataacttgggccggaaacgtagccttacagaagatataatggctctgagtgtaaatattctgatacccagagatgtatagactgtgtaaacactatgctgacttatgctctgtctgctagccgagatccgcgttaacttgaggtcctgagtgtatgagggctacttatacacatgagcgtactgactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424405 - DNA, 1088 bp, Homo sapiens
  misc_feature (54)..(54): n is a, c, g, or t
  misc_feature (64)..(64): n is a, c, g, or t
ttgatctgacggacgttatcacaaaggtgtggaagttttcccactgccccagtnactggaggtntgtaccaagagattccccgtaagtccgagagctggaagcgaggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424406 - DNA, 450 bp, Homo sapiens
gcatagttcctgacatgcagttagcacccaaagctttgctcctgcttttattttcacggttattagcccaccgaggtggtgaaggccaggggaagaaggaggctgggtaagacattaacccccattttaaagactgtaatcctggggctggcgtcataaggagtaacaggagacagtaaggttaagatgtcgggccccactcagaggcatcacggatgcttgagatggaggtgctctgtgactcggtttccccatctgtgagatggcagtgataacaccctgcctggcagggttggtgtgagtcagcctgtgagtgaggagggtcagaggtatcacagtgctgctgtttgtctttccttggtgacaccaggtggctggctttgatctggacgggacgctcatcaccacacgctctgggaaggtctttcccactggccccagtgactggag

SEQ ID NO: 424407 - DNA, 361 bp, Homo sapiens
gacccctgacccaggttacggaccggaagtgctccagaactcaaggtgagcggggcctgagctggagggggtgtggcctgctgcaaaagcgggaacaatccagagggacgcttggctgctacgcgggattgcagtggtgcagccagccccgaagtcggaaggtgctctctagggagtacaggaagataaagtttgtgcttgatttagaattagctagatcctttgggggagaggggatcgagccgatttcgggaggatgttcactgcgcggatgatgctcaggccatcgagaaatccagaaacaggcgacgaccttcgtcaagagaaaaatgatcctgtggagaaaagtaaatgtcgctag

SEQ ID NO: 424408 - DNA, 1632 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424409 - DNA, 1825 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagcctgaagcaggccacactccccagaaatgagggacccaatcacacaaggatgcaaatcctgactccacccctccaatcctcagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga
